United States Patent 12,642,819 (COMPOSITIONS AND METHODS FOR TREATING INFLAMMATORY BOWEL DISEASE) - sequence listing, part 34

SEQ ID NO: 12 - DNA, 5092464 bp, Bacteroides uniformis (residues 1-1,697,488 of 5,092,464)
  modified_base (559301)..(559397): a, c, t, g, unknown or other
  modified_base (859383)..(859482): a, c, t, g, unknown or other
  modified_base (1301297)..(1301393): a, c, t, g, unknown or other
  modified_base (3440424)..(3440522): a, c, t, g, unknown or other
  modified_base (4688253)..(4688348): a, c, t, g, unknown or other
  modified_base (4984156)..(4984253): a, c, t, g, unknown or other
  modified_base (4990279)..(4990470): a, c, t, g, unknown or other
ttgaaagtagagcatacattaggcggcaccaagataacccttgccgactatgcgtatgacaacttgggcagactgcaatcaaagtccctgcacggaagtgccaccaacaagctgacgtatgcctataatgtccgtggctggctgacgggtatcagtggaacgaagttcacacagaacctgtactacaataccggtaacggcactgccaggtacaacggcagcatcagcagcatgacctggaaggcagggaatgaaagcaccgtccgcggctacaagttcacctacgacgggctggacaggctgctgaacgcgacctacggcgaaacagccggcatcaatacgaacaccaaccgtttcagtgagaatgtaaccgcctatgacaaaaacggcaatatcaagaccttgcaacgttacggtcagaccgctgcttccggttacggactgattgacaacctgactttcaccctcgccggcaatctgttgaaccgcgtggacgatgcggcagcggcttccgcctacggtggcggcttcgagttcaaggacggcgtgaagcaggcgaacgaatacacctacgattccaacggaaatttaactaaagatttaaacaagggaattagtacaattacctataatgtattaaatttgcccaatatggtcacgttcagtgacggtagtacgattgcctatacttatggtgccgacggcacaaagctgaaaactgtccataagacaggcagcactaccaccacgacggactattgcggaaacgtggtctatgagaacggtgttcagaagttgctgctgactgatgagggttatgttactttgagtgacagcaagtatcattactacttgaaagaccatcagggtaataaccgggtagtcatcaaccagagcggcacggtagaggagacgaaccattactatccgttcggtggtgtgtttgcaagttcaggcaatgtgcagccttacaagtacaacggcaaggagcttgatgcgaagaaagggttgaactggtatgactacggtgcaaggcattatgatgcggcgctggggaggtttacgacggtggatccgtctgcggaaaactattattcaacgagcccgtttacttactgtttaaataatccgttgaattatattgatccgttgggaactgatactgtagatgtaaaggacgttgattggaataaatttgatccgaagaaggacgttgtggctttggatgaggtggctgtttctgtacctaatgctttgacaaaagtagggactagagctttagaaccaatttccggcttttgggggtatgtgggttattatcttttagatattggctctacctatcatagtgaacaaacgcggtttacatataaggtaggaacagatggagtaataacgggtgttgctccaatggtgggaacccctcctttgcctggttttgcaaagacgtcaaatttgaatacaattagaggattatggagtttgaccaaacaaggatcctctaaagtaatgaaacatcccattagaggtctattttataaaagtaaatcagatgggctatggtgggtaaaagaccagacaaagcatggcggtagtttttataaagtttataaagagacaaataaaggcttagaatggcataaagatgctgataagtatggaaatttcataattaataaacataaaagtgatgtagggatttttatcccatggaaggagctttcgaaatgagaaaacagatattaaaaatgcaagaaggtgaatctttcccattctgttgggtaaagtttgattctgattcttgtattgatgttcaagggcataaaatcgaaatatacataaaaaaagattcagttagcattgacgacatgaaatctctattttgtgatttgtttggtacagttgtagatgaattatctatctttagtccatcatggtgggacttttgcatagatacttggaatattcaagagaatacattttgctacgaccctcaatttttgtctaaagaaacggtatcttatttgcatatcttgcaagattcgaatattgctaaaggatattctggctgttgtgtctgtaatgattgggatacttacctatctgttgcattagattgtattatgaaaggaattgctccttatggaaactttatatataactcaaaggaacaattcttcttctattttcatcataccggtagtatagggctttattatgaaaatgaaactccatctatatttgcattaagaaagaatgataaatatgaggtgttatcttgctctgatgtgagtagattatctcaaatagaatgatttttaatcgctatcctaacatcagatatcctatatcttacatgttaggatagcctttttcagatttaaccgaaggaattagcagcattcaatataatgtattaaatttgccaacgggcgtcacttttgcttccggcggtttcatacagcatggctatactgccgacggcatcaagcggcgcatgatgtataaggaggcagatggttcgggcaatccggttcctactgtgtattgctgcaatgtggtctatgaaaacagtgttggcaggcttcttcttacggaagaggggtatgttacgctttcggacaagaagtaccactattacctgcaggaccatcagggaaacaaccgcgtagtcctcagttccagcggtgctgttgaggaagcgaaccattactatcccttcggtggtgtgtttgcaagctcaggcaatgtgcagccttacaagtataacggcaaggagtatgatgcgaagaaggggttgaactggtatgattatggtgcaaggcattatgatgcggcattgggtaggtttacgactaatgacagatttgctgagaagtatcattcgatgtctccgtatcagtatggggctaataatcgtagttcaaaaatcattaaataaagctggtatagaaacaatgaacaaaatgagagtaatcaataggcaaactggggacattttcaatgtaaaagtaaatccttatttgccaagtaaggcatatcaggctatagaaaagaacaatccattaggatacataataaggagaaataaatgatactaaaagggaatatgttaaaattaacaataccgtttttttgggctgtacaaagtatttggcttttatcgtttaaatccattgagacctttattgccgcaatcatattgttattaatatcatttcttggaatagttattaagagtaatacctataacattatatttttaggtatatgctttttatattcagtagctttaggtcttataatgttccttttatttctattctttgaattgcctatgatatatatattggtccctattatgaattttatagttttggtatatatgttaaggaagtatggacgaaggtaacgaagtgatttgcagcagatattcttcatctgatgtgttttaatattgctgagatgccccctaaaagtattttatccaacttttagggggcattgtatctaatctttggactttttagtattcctgacaccttgagaggtattgtcttgtcggacatctcataatcagcctgttcaacgtgaactattcttgaagtatcaggttgatgattcgagtaaggtaacgcttgccgcctacgcttatgacaatctgggccgtctacagagcaagtcgttgcacggttctgccgtgaacaagcagtcgtacacttacaatgtccgcggctgactgacgggtatcagtggaagcaagcttacgcggaatttgttttacaacagccaaatacaataacagcatcagcagcatgacttggaaggcagggaatgaaagcaccgtccgcggctacaagttcacctacgacgggctggacaggctactgaacgcgacctacggcgaaacagccggcatcaacgcgaacaccgaccgtttcagtgagaatgtaaccgcctatgacaagaacggcaacatcaagaccctgcaacgctacggtcaaaccggagcttctacctatggtctgattgataacctgactttcaccctcggtggtaatcagttgacccgtgtagatgatgctgtagccacatctgcttacaacaacggtttcgagttcaaggacggcgtgaagcaggcgaatgaatacaactacgattccaacgggaatttaactaaagatttaaacaagggaattaccaatatatcgtataattgtttaaatttgcctagtgtagtaacttttagtgatggtagcacgattacctatacttatgcagccgacggcacaaagctgaaaactgtccataagacaggcagcactaccaccacgacggactattgcggaaacgtggtctatgagaacggtgttcagaagctgctactgactgatgagggttatgttactttgagcgacaacaagtaccattattatttgaaagaccatcagggtaacaatcgggtagtcatcaaccagagcggcacggtagaggagacgaaccattactatccatttggaggggtgtttgcaagtgcaggcaatgtgcagccttacaagtacaacgggaaggagtatgatggcaagaaggggttgaattggtatgattatggagcacgtatgtatgatgcagcattgggtaggtttatgacagttgatccactggcagagaagtattatccgagagtccgtatgggtattgtttgaataatcctatcaaatttattgatgcagacgggagactgccaagaatttatatcgaaagaaaaggttttggacatgcatttgtaacagttggcaatggtgataatacaattgtgtatacctatggtagatatggagaattgggaaaagataaaagttcggcacggaatacttcgcctacaggagaaggagtgcttattaaattgacgggtagagatgctattagctttattcaggatcaaatgcttgctaatgaagcagtgggatatgagtttacaaaaggttcagatgaacttgtttcgaaacactttgataagcaattagataatagtaataaaatacctcaaaaaggtaagtatgcaggtaaagaaaatgcgaaagttattgatgaatataatttatttattaacaactgcgctaccacttccataaaaggtatacaagagggagtaaaaaaagatttggatttgaaagattctaaagcccctgcttctttaggagaccgtttgaaagtaatgtctaaagaggatgagcatagtatcagaagaattacttataatgaaataaagaaagagtttaatttgcatggagctggaacaaaatggtaattatgaaaaaggttattttaatggtatttctgatattctcattgttgatgattgtctatgggataggttttattcttaattattatttagtgataaaatattccatagaagactgtttgcccttaggtggtaaaggcactttcccggtagtgagtgacagattagatgaaatacatgctcttgtcaattatgctgaaatagtagttatatatgcaatttatgctttatcattggctgtatattggttgcttaacattaataagaaataatctgtcttagttgactaatctctttaataactatcctaacatcagatagctcatatcttgcatgttaggatagctttttttctttctaatactgatacgacggccttaaccgtctgactgctttcacccacggcgcaggccgctatacagaaaaggtgaccggttacgacaaaaacggcaatatcctgtctttgcagtgctacgggcagacctccgcatcagtctacggcttgatcactcttacgggcaatctgctgaatcgtgtggacgataccgctacgacttctgcttacaacaacggtttcgagttcaaggacggcgtgaagcaggcgaatgaatacaactacgattccaacgggaatttaactaaagatttgaacaagggaattaccaatatatcgtataattgcttaaatttgcccagtgtggtgacgttcagtgacggcagcaccgtcacctatacctatgcagccgacggcacaaagctgaaaactgtccataagacaggcagcactaccaccacgacggactattgcggaaacgtggtctatgagaacggtgttcagaagttgctgctgactgatgagggttatgttactctgagtgacagcaagtatcactattacttgaaagaccatcagggtaacaaccgggtagtcatcaaccagagcggcacggtagaggagacgaaccattactatccattcggaggggtgtttgcaagttcaggcaatgtgcagccttacaagtacaacggcaaggagcttgatgcgaagaaaggggtgaactggtatgattatggggcgaggcattatgatgcggtattgggtaggtttacgacgaatgacagatttgccgagaaatattattcgatgtctccgtatcagtatggggcgaatagtccggttgggaatattgatgtgaatggagatagtattagagtttacactgaaactcagtcctttggtcacacgtggattagtgttggtgaaggatctaatatgactgtttatagctacggacgatacaatgggactaacaaaggaccagatagaagctctaattctttaggaaacggttccggtgttcttttaaagttaatgggggatgaagcaaaagcttacaatgacaaaaaagcagctggcggaatgtctgtatttgtagtaacagatgtggcagatgaaaaagttgctaatattttagacgaaaagtttaatatgtcaactacaatgccagataatcctaaaagtgattattataacagttcttctgctcgtattattgatgaatataagctgacaagtaataattgtacaacaatggtatctgatgtattgaataaaagcgggtcaaatgctctgaaagagacaaggctacaacaaacaagcaattttggaacatggactactattcctattgtcaacagatttattcttccaatatcaatgcagaatcatttagtgagaatatccaaacctggaggtgtagtttataaaacaagatagattatgaaatggcttagaattgtgtttgttgccacatcaataattctttcattagtaattgtatgcgcaattattaattgtgaaattagttataaatatgagattgaaaatcgatgtggggataaaattgatatcttatgggttgaggagtggctaaaagaaacgattaaagtgtggaagttttttctatgctatgtaatcattaatatcttttatttaatagcttctcttgtcaatagccgtaaatcttcaaaagaaaaatgcagtttatcataaacaaacgcagtctcttttgtattgataattagggcgtcttgacctgatatgaattgactattttatcgctatcctaacatcagatatcttatatcttgcatgttaggatagcttttttctttctaatactgatacggcggccttaaccgtctgactgctttcacccacggcgcaggccgctatacagaaaaggtgaccggttacgacaagaacgacaatgtcctgtcttcgcagtgctacgggcagacctccgcatcagtctacgccctaatcattcttacgggcaatctgctgaatcatgtggacgataccgctacgacttctgcttacaacaatggcttcgagttcaaggacggtgttaagcaggcgaacgagtacgtttatgatgcgaacggcaatttgaccaaagatttaaacaagggaattagcaatattacgtataatgtattaaatttgccaacgggcgtcacttttgcttccggcggtttcatacagtatggctatactgccgacggcatcaagcgacgcatgatgtataaggaggcagatggttcgggcaatccggttcctactgtgtattgcggcaatgtggtctatgaaaacggtgttgccaggcttcttcttacggaagaggggtatgttacgctttcggacaagaagtatcactattacctgcaggaccatcaggggaacaaccgcgttgtcctcagttccagcggtgctgttgaggaagcgattactatccttttggtggggtatttgcaagctcaggcaatgtgcagccttataaatacaacggcaaggagtacgatggcaagaagggattgaattggtatgattatggggcacgcatgtatgatgctgcgctgggaaggtttacgacggtggacccttctgctgaaaattacttcaatacaagtctctatgcttattgcgggaataatcctattaatcggattgaccttgacggattacttttggctcgaatattgatatataaggtcctctgattcaataaagtgaacgattccctgctttcatcactatatgtcaacagggaattttaccttttatataaggctacaccctttccctgacatggtgtagccatttaccccaaagggtgtagctatccggggcaaagggtgtagccttgtttaatgtgccttaccagtgcctgcggcacacataatccgtcattgactcatgaaaaatcttctgtcgtaagtgggaagaaagaaatttgtttcaaatctccccgaaatcatgtacctttgtggcggtacctaaaaaggaggtaacaagatgatgaataagataaattccgtatgcgtatattgtgcttcgagtacaaagatagattccgtttatttcgatgcagcccgtgagttgggcactctgctggggcagcggcaaattcgcctgattaatggtgcgggaaatatgggactgatgtccgctgtgtccgatgcggcactccgggcagggggagaggtgacgggcgtcattccccgcttcatggtggagcagggatggcatcacaccggacttacccaactcgtggaagtggaaagcatgcaccagcggaaaaagacaatggccgacctgagcgatgccgtcatcgccctgcccggtggttgcggcaccctggaagaactgctggaaatcatcacttggaagcaactcggactgtatctgaacccgattgtgatactgaatgtcaagaactatttcgaccctctgctcgatatgctccggcaggcggtggacgaaaacttcatgcgtacgcagcacggtgccatctggcatgtggcgcagacaccgcaggaagccgtggaactgatatataccactccattgtgggacgcctccatccgtaaattcgctgcaatatgataggactgttgatggcttgtgcagtagtggggacggaggggattcctatcccatattctccgagaatggacgatggcatcaccgtggttcttttgtgctgtttctttctgtcggcctatgttttgtcacgcagccgcaagttcctgctgcagctggtgaaggatttcctgcttcatcgcgaacgtaccagcatatttgccacttccacagccgccgatatgcgctatctgctgttgctcatcctgcaaacctgcatccttgtgggtgtctgtatcttcagctacttcaatgatatacagccggaattggtacaccatgtgccgccgggatttctgctggggatttacatcggtgtgtgtctcctctatttgtgcttgaagtggatgctctactcttttctgggttggattttttttgacgaaagtgttacaacactatggcttgagtcctattctacgctactttattacttgggattcgcccttttcccgtttgctctgttcatagtctattttgatttgagtttgcagctgacgataataataggattgattttagccttttttgctaaaatattgatgttatacaagtggttaaagcttttttgtaacaatttatatggcggtttgcttttaattgtgtacttttgtgcccttgaaatcatgccttgttttgtgttatatcaaggtgtgatgcagctaaacagttatttgataataaaattttaggacgttgaaaattaagaaagtacttgtgtcgcagccgaaaccggcatcagagaaatctccttactacgacatcgccgagaagtatggtgtgaaaatagattttcgcccatttatcaaagtggagagcctttcagcgaaagagttcagacaacagaaaatttcggtattggatcatactgccgttatttttacttcgcgtcatgctattgatcatttcttccacttgtgtacagaattgcgtgtgacaattcccgaaacaatgaagtatttctgcgtgacggaggccgttgctctgtatatccaaaagtatgtgcagtatcgtaagcgtaagattttcttcggaaacaccgggaagattgacgatttgataccttccattgttaagcataagactgaaaagtacttggtaccaatgtcggatgtacacaatgatgacgtgaagaatctgctggataagaataagattcagcacacggaagctgtcatgtaccgtactgtcagcaatgactttgctgcagatgaggcttttgattatgacatgctggtgttcttcagtccggcaggcatcagtgccttgaagaagaatttccctgattttgaccagaaggaaatcaagatcggaacattcggctctaccactgcccaggcagtccgtgatgccgggcttcgtcttgacctggaagctcccagcgtgcaggcaccctcaatgacggcggcgcttgacatgtttatcaaggaaaataataaaggaaagtaaaaagagttatgagttataagttatgagtgatttgcttatagcttgtaggcataacaatggatttataaaattgagctacaagtggttgtgcttttatgtcgccaggtacttgtagctcgtttttgtatcgccccataacttatcactcataactcatcactcataacttataactcatcaccccatgccaaataccttgcgtaagtccgaacggttggacaagaagaaagtgatagagaagatgtttgcgggcggctcacgttcgttttcggttttccctttgcgtgtggtgtatctgccggtggaggagctggaggcacccgtttccattcttgtaagtgtctcgaaacgccgtttcaagcgggcggtgaagcgcaaccgcgtgaaacgccagatacgtgaaacctaccgcatgaacaaacacggactgctggcagtgttgacggaaaaaaagtgccgtctggccgtggccttcatctatctttcggaccagttggtagactcttctgtcatcgaggaccgtatgaagacagctttggcacgcattgccgagaaggtagcggcaaatgctgaaaccgagcaaactccgcaggtgtcatgaagcgtctgctttcatatctgctgctgcttcccatctatttctatcagaagtgcatatcgcccatgatagggccttcatgccgttttacccccacttgttcgcaatatgcggtggaggccatcaagaaacacggacctttcaaggggttttgtctggcagtcaggcgcattctgcgctgccatccctggggaggttccggatatgatcccgttccatgaatattccagttgacatacatacacaccggcttccgcaagtacccggaactgccattgcaaattgctatcccgaaacgttctctccacagagcggcggatggtattcggtggggatacatccctggcatataggtcggagtggaggtgaacactcaggagccgaaggtgctgtggctagcagggtgtgcggcctggaggagttagtgcgccatccccaagtacttgccgtgggcgaagccgggctggacaagctggcagatgctccgatggatttgcaggtggaagtgttcaggtgccaggcatgtttggcagaggaagtgggaaagccgctggtgattcatctggtgaaggcggttgatgaactgctgaaggtgaagcgggacttgcgcccgtcgaatccgtggataatacatggtttccgtggcaaggcggcgctggtggaggaatatctgaaacatggcttttacctttcattcggggagaaataccaggaagcagccttgtgccgggtacctgccgaccggctgttcatcgaaacggatgaaagcgaagtttccatcggggaattgtatgcacgcgctgccgaagtgcgcggcatctctcccgaggagcttggagaaacactccggagaaatgtctgcaaagtcttttttaaaccctaagagttgtttcttcgaataaagagtcgtatttttgcgcagattaaaataggaatcaaacaattcatagataatcacttaaataattaatcagataacttaatcattcgatgaattttgtagaagaattaagatggcgtggcatgctccacgatatgatgccgggtacggaagaacttctggctaaggaacaagtgactgcatacattggtttcgaccctactgcggactctttgcacatcgggcacctttgcagtgtgatgattttgcgtcacttccagcgttgcggacacaagccgttggcactgattggcggtgctacgggtatgattggtgacccttccggaaagtctgccgaacgcaatctgcttacggaagagacgttgcagcgcaacctggccggtatgaaggcccagctctccaagttcctggattttgattcggatgcccccaaccgtgccgagttggtgaacaactacgattggatgaagaacttcactttcctcgattttgcccgtgaagtgggtaagcacatcaccgtgaactatatgatggcgaaagattctgtaaagaagcgtctgaacggtgaggcacgtgacggtctttccttcacggaattcacctaccagctgttgcaggggtacgacttccttcatctgtatgaaaccaaaggctgcaagctccagatgggtggcagcgaccagtggggtaacatcaccactggtgccgaactgattcgccgtacgaacggtggggaggtatttgcactgaccagcccgctgattacgaaggccgacggtggcaagttcggcaagacagagtccggaaacatctggctcgacccgcgctacacttctccatataagttctaccagttctggctgaacgtgagcgacgaggatgccaaacgctacataaagatattcactgcactgtccaaggaggagattgacgctctgacggccgagcacgaggctgctccccatttgcgcgtccttcagaagtgcctggccaaggaagtgactatcatggttcattccgaagaggactataacgctgctgtggatgcatccaacatcttgtttggcaatgcaacttccgatgcactgaagaagttggacgaagatacgctgctggctgtgttcgagggtgttccccagttcgaaatatcccgtgatgcactggctgccggtgtgaaggcggtggatttgttcgtggataatgctgctgtattcgcttccaagggcgagatgcgtaagctggtgcaaggcggtggcgtttctctgaataaggagaaactggctgctttcgaccaggtgattacgacagccgacctgctggacgaaaaatacctgctggtacagcgcggcaagaagaattactatctgattatcgccaaataacggtagcctaaagagaagtaattaaggaaatgatgcttcggcagtaaaaatagccccgaaatatttggatatttcggggcttccttttatctttgcaccgctttttaacagaaagccctatgtttggactatggtgtaatggtagcacaacaggttttggttctgtttgtccaggttcgaatcctggtagtccaactacgatacagctaattgcagctaaaaacccactaaaatcgcaagttttagtgggtttttttgttattctttccccctcttgttggcactataggtatagattttttctttttacgaatctttgaacgatattgctatataattgacacaaatttatacggtttctccattttcttttgttacatttgcatcgtgtacgcaaacgatgtgtatttgatggctgaagttataacctattaaatgtagtgcaatcatgaaaacgaactatgaaattcgctatgctgagcatcccgattatgtgaaaagctacgatatgaaaagcattcgctgcgatttccttatagggaaggcattctcccaaaataaagtttccattgagtataaactacttgcaaatcgtacataaatagaatatcacttatttaaacttaataatttaacgttatgaatccgtatttgaatttttctttggaaggtaaagtagcccttgttacaggtgcttcttatggtatcggttttgctatcgcttcagcttttgcagagcaaggagcaactatctgtttcaacgatatcaaccaggagttggtagacaaaggcttggctgcctatactgaaaagggtatcaaggcacgcggttatgtatgtgatgtgacagacgaacctgctgttcaggccatggtagcccagattgaaaaggaagtaggctctgttgatatcctcgtaaacaatgccggcatcatccgccgtgttcctatgcacgagatggaggctgctgacttccgtcgtgtaatcgatatcgacctcaatgctccgttcatcgtatcaaaggctgttctgcctgccatgatgaagaagggccacggtaaaattatcaatatctgctctatgatgtccgaactgggtcgtgagactgtgtcggcctatgccgctgccaagggtggcttgaagatgctgactcgcaacatctgctctgaatatggtgaatataacatccaatgtaacggtatcggtccgggttacatcgctaccccgcagactgctccgctgcgtgaaaagcaggccgacggtagccgtcacccgttcgactcgttcatctgcgccaagactccggcaggccgctggctggctccggaagaacttaccggtccggcagtgttcctggcatcggaagcctctaatgcggtaaacggtcacatcctctatgtagacggaggtatcttggcttatatcggaaagcaaccgaaataaatttaaggataattgagaaggtgataaagtggcaggataatgtcacttgtcacctttttcttttgggcgcggattacgcggatttcgcggaaaggataaggaaaatccgtataatccgcgaaatccgcgcctaaaagaaagttatacaactgattaggaaaaagcaatgattatatgagaaactttcttttattatgtatggcggccctctgctgtcttgcttgcaacgatagcaagatagtgactgttacggtaaccaatccgttagcgatggaccgttccgatgagatggtagaggtgtccatgaccgaaatctcaaaccttctgaatctggcagacaccgcacagattgtggttctgaatgtcgaaggggagcaggtgccttaccaagtgacctacgatgacaaattaatcttccctgcgacggtagctgccaatgcatcggctgcatataccgtccaggccggtactcccgtcgatgtggaggtaagggcttgtgggcggcagtatcccgaacgtctggacgacatggcctgggagaacgacttggtaggcttccgtgcctacggtcctgcattgcaggcaaggggtgaacgcggtttcggctacgacttgtttacgaagcgaggcactgctgcaccggtactggaagacatgtatgccaaggaactggatgcagactcctggaagcaggttaatgaattgcgcaagacagacccgaaggcagccgatgagctggtacgcacattctcctatcatatagaccacggttatggcatggactgctatgcagtaggtccaacattgggagccggagtgtctgcattgatggtgaatgataccattatctatccgtggtgctacaagacgcaggaggtgctggacaacggtccgttgcgcttcaccgtgaagctggagttcaatccgttggctgtgaaaggggatactgcggtggtggaaacacgtctgattacgctggatgccggttctcatctgaaccgtactgccgtttcgtatagcaatctaaaggaatctttgcccattgttaccggtattgtgctgcacgaaccggacggtgctgtggtggctgatgccgccggtggctatatgacgtatgtagaccccactaccggaccggataatggcaagatatttatgggggccgctttccctgccgttgtgaaggaagccaaaaccgtgcttttccccatagaggagaagaagatgcgtaacaatgcggacggtcatgtactggttgtcagcgactatgagccgggcgctgactacgtgtattactggggctttgcctgggaccgcgcagacatcaagactgctgaagcctggaaccgatacatggctgattttgcacagaaggtgcgcaatccgatgacggtgagtatccgctaagttgattttcttccttttcagacggagaagattgagaagttggaggtttgtaactgtccggacgaatgacaaatgttctcagaataagctcttccccttgtagacaagttctgcaacgtttttggcctccagtttttccatcaggcgcttccggtaagtctgtattgtattgatgctgagaaatagtaattgggatatttcagaagtgctcagtccttgcgagagataggcgagcacttctttttcacgtctcgacaattcgggaagtgcatgtggtagggtgttttgtttttccttgtccagttcgctgaaaacattgctgaagtatctggttccgtttttcagtgtactgatggcgtctctcaattcgctggtgctggcattttttgaaacagctccgttgatgtttagggtggataatttggctatgatccaaggttcttcatgcatggtatagattaaaatgccgcattcgggtatccggctgtgaaggtgggatatgagttggaatccattcatatccggtagttcaaggtcaatgatacaaaggtcgaatctctctttgagggtcagttgttccacgtcttttgcacaagtggctcctttgcacgtcacttcttcgagttgcgaggccaatgcgatgatgccttcagcaacaatcgggtggtcatctattaccagtattctgtatgtttctttgtttggtttcattcgtttatgttaagcagtagggtgaaaacgttgttttctgttgacgagcatacattggcggtagcgttgatggctctgatacggtcgtttacggtgcgcaatcctatgccgtcattgttgtttgttgctgtttgttgcttgtttgcattcttaccgttgtctgtaatttgcagggtatatttattttcattgtcggcacggagactgatgactatatgactggctgaggcatgtttcacgatgttcatggtgagctcttgtacgatgcggtacagctcataagcggtttcattgggaagatggcgtgatgcgttgttctccgttggatgatagctgacctctatgccggtgttctcggtcagtttggcagcataacggtcgagtatctggtctagactgagatgctcgaattcgggaggcatcagttcgtgtgagatattccgcacgttgtttctcagtttgctgacgagtgaggccagttcctgctcattccctttgccggcagaagtttctatcttcatttgcagccccagcaggtcgttggctataccgtcatgcagttccttggcaaaatatttgcattcctcttccaacccttcaatgtagcggcgtgccgagttcagttcgttttcttgctttagcagttcaatcttcttttcggccattcgtttcttgtggcggagcgtcaacaaagtaatgagagcaagaccagacagaagggctacagcaatggaggcttttagcaggaaggcttggtgttccagttgttcttgttgcaggtgggctatctccaattccttttcttgtgtgtgatatttcacgttgaattctgccatttgttgcgtcagattgtgctgtgccagcgtatcagtccacatgcgggcactatccatataggtgtaggccagtttggggtttcccaaggcatcgtagcatcgtgccatttgtgtaaataatgttttgggctcggtaccggttttccggttacgcagccagtggaagtccttcaaggcgcgggcatagtttttgcggtttgtttcggtggctgccctcgattgtatgaatcctatggcagcgatggagttggatggtacccgttgtagtagtttgttccccaatttcaagtagtggtctatggaatcgggttgttcttttcgttcaaagagtctcagcatgccgggcaggcagcgtatcttccataggtcttcgtttccctctccgtggcaggcaatgttccaggctttgcggttggatttttcagcatcatccagcttgttcagttcagcctttatggttgccctgatttgccaggtggtgaaggctacgaatgggtcttcggttctggcggcatgttcggcggccatgtcggtatacttttcggcttcgttcagctgcctgatattgaagtataggatggacacattgttgcagatgtgggctatccagctttcgtccccatattgcaaggcactgtccagtgctttattgtaatagtagagtgtagagtcattcatttggtgctgacggtagaggaggcccaaatcgttgtatacgctgatgtgcttttccaaatcatctatctgcggcaggtaggggagcacatttttttcatggcaaaggcttcttctgtctttcccacatagaccagcagtgtggcttgttcgttcagcaagatgggatacatgaaggagtgctttacgttccgggtggcaaaggcgctgtcgaagctacgttgcgcttcatcgtagtgtccttcttccatgagattggctgcccggttgtagaagtgtgccaacagagtgtctgttggtatttctccggcgtgaagcaggatagtggttaaagaaaagaggagtgataatagcttagtatggcgtaccctcatatcggtatattttagtggaattcaatctgtgcttagttgttgcaaatatacgtcttattcattttgctttttattggagatgctgaattttttctgtatgtggctgaaaaatcacctttttcagtgacaaggagtgaaaggaaaagtttattactttgcaaaaaatattaagctttgtctgggaatgataaatggccaaaagtatctgtccgggtttgaatggcagagtcttgttgtcgtgagatacggacggcattccttatacttttgttattatggattttccttagagggatggggataaaacaagatttgtaacttatgaaaatgtttaaaatgatggctgcctccatgttgggtgtggcgttgtgcttgggattcactgcttgcagtgacgatgacgaaaatgagaatggtgagggtggcgaaaacaccgccactgtggtcaatccttcgcaagtgtttacgggagggcttccgaagtcggtttcgggcatggcgatttctcacaatgaagaagggctggtgacgaacattacaactgaggatggggataaagccgtctttgagtactttcccgctactacaaaggcagatgttgcaaaggaccgagcaagaatcaccgtgacggatgaagagggcgatgttacagaactgaacttgcagctcaacagcgatggttatgtggaattttgcaactcaatagaccacgctggtactcccgatgccgatgagtttacttgggagatggaatacgacactgaaggccatctggttgtaatgaaacgctctgaaagcgatggtgaaataacgaacatcacctataaggatggagatgtggtgaagacttccacacgttatgtagctagtggggatctcaatggtgacggaattatcgacagcaatgacgagtgggagtatagtgctgccatagactatacgacggataatataacagctcctatcgagaataagggctgcctgatgttgtttgatgaaatactggatgtggatatggacgagatgatatatgcctattatggaggtatgcttggtaaggctacgaaacatctgccgcttgtagggcattatacatacaatggcgaggactctgtgtccgatatgtattttacatggacattgaattccgacagttatcctacggaactggttgtaaaagaccagtgggatgaatacagatgtacatttacttggtaattataaaacatctgtttattcttgtggaacaggacatgagcctataaaatgtaaggggttgccttttgccgagacaaccccttcttattttatgtggaatttattgttacagcagatgttggtaactttctgctgtttcaagtttataatactttgaattcatatccctcttccttcaggaagtcaatggcgcgcggcaatgcgtactgcaggtttccgttgcaccaggatttcagggaatcgtggaaggtgatgatggagccgttgcgggcgtagcgcatcacgttggcaagcacttgcggaccgcgcagcttcttgctgtagtcgcgggtcacgaggtcccacatcacaatcttgtaggttcgtttcagcgtgagatactggttggcgaacatatggccgtggggagggcggaacaagagagggtagagaaccttctccacattgcaattgatgtccccacccatttccatgaaaatcttcgcctgttcggtatttcccagataattcttggccgtgtattcaaatccacggatatggttgaaggtgtggttaccgatgcggtgcccacgctcaacgaccatccggaattcgtccggatgcttccgtatgttgtcacctaccatgaagaaggtggctttgatgttgtgcttatccagcaggtcgagcacccagggagttacttcggggatagggccatcgtcgaaagtcagataaacggctttttcattggggtccatcctccagactgcaccgggatatagtttgcgaaaaaactcaggaggttgttctataaacacgtgattaaggattaagggattagggattaaggattaggggttaatgattaaggattaggggttaaggattagttattaatgattagtgattagtgatgaactgcacaggctaatccctaatcctttaatccctaatccttattctcactccttcattctgtccacatacatattatacagttcttccaccttcggctcgtagatttcggcgagcttggagttgtacttcttcatggcctttacctcggcatcgagtacagcccagtggtattcaaattcacgggtagaaatcatgaagcggttgtcgtccaggctcagataccaggtcaggtactctacagccttgtcagcaagggctttcatcatctcgtccgccttggcggtttcgcccagttggtagtaggcttcagccatctgtacggcaccgttctgccagtcgtaaggcacgttgtaggcgggaatcatcttttcggcatagtccagggcggcttttgccttgtctttcttgccctcacgcatcagctgctgcacgagttgggagaagatgcgacggtgagagtgacacatgcgcattgcgttctcgtcgatatagatgcccggcttgtcgatgccaccgaacttgaacttgttcatcaggttgtcgtacatcttttcggagtctattgtcacgcctgtcttactggtgtcgaacggagtgaaacgataggcaagaccttcctgaacgaagtggttttccatattcagctggttctccctgcctacgctgacagcgatatagatggggcgttcccagttggcctcgctcagcatttcgagcatcatcaactcgctcttgtagagggcgcgtttgcctttcagcgaaatgtgcatgtagtcggggattgagtcgcccggtatcatcatgccgctgcggcgcacggcttccttgtctaccttgatgacaatgctgtcggtaggaatcaccttcaagtcctgattcttattgcgcacccagttcttgaggatattctttagctcatacgggttgtcaccgaattctttctttacattgaccagtgcttcgggattaccgtccagtgcctgcttctcggcttcggcatagagctggtcgatgcttttcttgtactcaggctggatggggacgtattcgttggtgccttctacgtactccattcggtcccacgtgatggggagagaaggactgtcgtaggcggggcgcttcatctggtcgatgtaccaatcggtctgcaggtacgagaggttgcaggtgcgggcgtcggtacggaaaccttcggtctcctggttgtaccagagggggaaggtatcgttgtcaccgttggtatagataatcgggttgccgctttcttgtagggacatcaggtagttctggccgaagtcgcgtgccatgtagcggtcgctgcggtcgtggtcgtcccaagtctggcttgccatctgcacggggacaaagaggcaggctacggaaacgatggcggcagcaggcagttccttcatcttggcatagtcttgaagcagacggacgagtcctgccacacccataccaatccagatggcgaaggcgtagaacgaaccggcgtaggcatagtcacgttcgcgcggttggctcggagtctggttcaggtagagcacgatggcaataccggtcatgaagaagaggaagaagaccacccagaattgctggatgcctttctgtccacggtaggcttgccatagcaggccgatgatacccagcagcaggggcaggcagtagaatacgttgtgtcccttgttgtctttcagttcctgaggcaagaggctctggtcgcccaccagccagttgtcaatgaacgggatgccggtaatccagttgccgtgttcaatttctccgctgccttgtatgtcgttctggcgtccggcgaagttccacatgaagtagcgccagtacatccagttgagctggtaggagaagaagaacttgatgttttcccactgtgtgggcatgtttaccataatcatgttgccgcatttgtcatagggcacatcgtaacccttgatgtcctgccaggcatggtattgttgtgtatgggcactgctgtacatacgcgggaacagcatgttctgggcgtattcgtactcaatgcgtccggggatttcgatgtacgaatccttttcgtcgggcgtagctttctccttgcggatgaacttagtgccgttgtacttgatgcgcggttcgcagtaaccgtctttcacgtccagtgccacttgcgaggagaaggcagggccatagaacagcgggcgtgtgccatactgctcgcgtcccaggtattcgcccagtgtgaagatgtcctccggagagttctggtccatcggcgtgttggcggtggagcggatgacgataagtgcatacgaggaatatccgatgacaatcatcatggtgcagagcagcgaggtgttcagcgtgcgtgccgatacgcggaatttctctttgacggctgcctgcgtcttcggacggaggtagagccacaatgcggcaatgacaataacaccgataactaccgagctggtaccgtgtccgtagaacgggatacccagcatggcgatggtgagtatgaacgagagtgccatacgtgccttgttgcgttcggtatagctttcgtagataccccagatgaggcaggctgccaacagaatgatatatacgatgacacccgtgttgaaggacatgcccagcgtgttgacgaagagcagttcgaaccagccgcccactttcacgatacccggcacgatgccgtagagtacggctgctaccagtatgcccgaagcgagcaatgccagcagggaacctcgggcattggcgttgggtactttcttgtagtagtataccagtacgatggcgggcaggcagagcaggttcagcaagtgcacgccgatggaaagtcccgtcaggtaggcgataagaatcagccagcggtcactgtgaggctcgttggcaacgtcctcccatttcagtatgagccagaatacgacggcagtgaacagtgaggagaaggcatacacctcgccttccacagcgctgaaccagaaggtatcgctgaacgtgtaggcaagtgcgcccaccagaccgctacccatgatggtaaccatctggccgcgtgtgatattgttttcgtctgtcaccacaagtttgcgtaccaggtgcgtgatgctccagaaaaggaacaggatacatgcgccgctcatcagcgcgctcatgtagttcaccatcttggcaacggtggaggcatcggaagcaaattgtgagaataggttggctaccagcatgaagaacggtgcgccgggcgggtgtcctacttccagcttatagccggtggtgatgaactccgggcagtcccaaaagcttgcagtaggttcgatggtcatgcagtagaccgtcgctgcaatgaggaaggtaatccagcctacaaggttgtttacggttttgtactgtttcattcggatgaaattcgttattattcagttttgttttttacaagctgttttgccatcgcttagtcaacgtattggcatatatgggcgcaaatataatgatttcgcttctaaataggtgacaataagcagcattattaggataggttaagggatttgctgcatctatagatgcagcacggtggaagtatagatgcaacgcggtggatatatagatgcaacaatgatgattctatagagggaatatccggccgataaaggggatgcggaaaggaagtatcctccttgcttgtctaaatgaatctttcgtttataaccgaaaatctagcctttttcgcaaactttttgggttatgaacgaaagaattgatggaaatgttcgtttataaccgaaaattgttatctttgtaactaaagtttaggttatggacgaaagaatggatatacttaggaagtacaatctctggacagaaggagattttgacttcggtttcatgcgggtagcttataccggcagaatcatggactacgtaggcaatcgtcttgtaaaggtgctcatcggtcagcggcgtgctgggaaaagttatgtgttgagacagatagcaagggaactgataagaaacggtgtccctccgcagaacactttgttcatcaaccgggaactaagcgactttgcttttttgaagactcacaaggatttggaagagttggtgacgctttataaaagcgaactgcaccctcaggggaggatatatattttcatcgacgaagtgcagctcatccaagaatgggaaaagtcggtcaattcttattcgcaggactataccgaggagtacgagctctttatcagcggctccaactcacggatgctgtccggtgagcttgccacgctgctttcggggcgatacgtccaatttccgatatatcccttcagctatcaggagtatacagagataaggcatctggaacagaaccgtgagagctatatgggctatatgaatacgggcggaatcccggacctttttgtcttgcccgaaaagcaggaggtgcagcgcaattacttgtctgccttgaaggacaccatcttgctgaaggacatcatccaacgctacagcatacgtgacccccggctgcttgaggacctttttgcgtttcttgtaggcaatacctctaatttagtgtccatcggcaacatcgtaaactatttcaagatccaaggccggaagacgagctatgatgccgtggctgcctacataggctatattgaagactcgttcttggcgtatcgttgtgaacgcttcgacttgcgcggaaaggaaatactgtccggtacggcgaaatattacatcaacgaccttgcctttaagaatttcctctatcccggaacagcctatggtgtgggttataaactggagaatcttgtctatctggagttgcttcgggcgggctatgatgtctataccggatgtgctaaagaaaaagaggtggacttcatcgctcggaaaggtgaccgtacgatatatctgcaatccacctacatgctggtagatgaacagacggtgcgccgtgagtatgcttcgctggaggcgatacaagataattatgagaaactggttgtttcgcttgatgatttctgtctgccatccaatgaaggaatacggcatgtgtgggcgtgggaactgcatgggttgttataaaaggtgctgaaaggcagtaatatccttatatttttgacaaaaagtaatgtttctgtagatttctctgccgcacatggttgggcagaaggacgaatttaggatatattgtggatattggggtcataaagatgcgttcttcttgcatattcttccgcttttgtagggcttttatgcagaaattggctacacctttaagctaaaagggtgattgctttttactaaaaggggtattgcgttttagtaaaacggttactctgttttaataaaacgttcttttgcttttgcattttcggtgtatcagggctttcggaggtgtgatttcgatttattagaaggacgttcgttttggtataatgcttataacctgacacttatggattttcgctctcgtatttctttctgtgtggataatcggtccgaaatacgggattctcgtgcgatagaaaatacaaagtgtcagaatgacaaaatcatatttatcttctgtaggtatcagccttaaaaatactttccaatctttttcttgttttcattctttatcgttaaatttgccatcgaagcaaggaagtgtccttagcttcaatgttttgtgaaatgatattgtaagaagcgttgtgcttcattcttgtctttgagaacctgagaaattcatcaatgatacacaagaatggcatggactgctcctgtgctggtttcggcgtgggtctgctgtctgttcatttgtatagtggggttttctcaggaccttcaaagacgatggatagcacgcagttccacgttctttttttatattcagcaatactccctcctgaaccaaagctcgaatatcggatcggagaaaacatacttgttcccctctttctcaatgaaatcacgttctgtcagcatacgcttgttgcgtgtgatggtctgtgcactgcccaattcatatttccgcactacggggatggagttgaagcggtattcaccgtcggctacagcacgaagcatggcagtttgggcagcagtcaggttctcggtgtcgttcatgaacagaggcatgttggtgtctatcagttggcgggtacggatttcgataatctcatctgtcactttttcagacgtaccgctccagatgaaatagcacaactgttgcaaataccacgaatggcatttcacgatgtcgcacagttgttctgcttgctgttcgctgatttctttgttcgtccggtggaaggcattgacgatgaagggcacccattcctctttctttatcttttgcaggaacagtacttgtccgaagcggtagaaggggttagaagaattgttgaagatgtccatcatcatatgccgcttgcttccgtaaaagcaataggagacttgttgctgcttctgccaggcagagcgcatttttccctccatacttttgtagccgggtagtagtgccagttgttggaactcgtcgatgcagacaatcaggtgtatgcctttggcagctgctatcttttcgggtagttccagtatctccatgacacttttttcttccagttccaatttcaggtcaaaggagagggtatcggttgggtcgctcttcaatgtgatactgggagaaacggctttaagaaactgtttcacatcttcaagcctcttttcaagggtggaggcggcgcaagaaatgacttctcgcgcaaagatgcggtagaattcagcttccgtcttgatgctgaatgcatcaatgaagcagacacggatatgcttgtcttcttgtgtcagttcgtccatagctacttttacaagcgacgattttccccatcggcgcggtgaaataagcattacgttgatgcccgatccaagtaattctttcagttgctttcgttcttctacccgattgacgaaactttctttatcaaccagtgtgccgtattgaaaaggtgatttcataaactttctgttcttgatttaatgacaaatatacaaattatacatcaatgtataatacatcaatgtataattttgtttgagcacatgtgcaaaaacacccactttttgcacatgaaacggagaacgtgagcaaaaaagccttatttttgctcgcgttattgattccgaatataatgttaaatacaaatatactatgaaaagtaaggttcttgcattgattctattatgcggtgccgcctcgttgggcgccaaagtaaaactgcctgcattggtgggcgacaacatgatactccagcagcagactgaagtgaaactgtggggaacggctgctccggaagccgaagtacgcgttacgccttcgtggaacggacagacaatgacttgccgtgccgataaggatggcggttggacgcttgccgtggagactccggtagcaggatacacgccttatgagataacttttgatgacggagaaaaaactacgttgaagaatatcctaatcggtgaagtatggcttgcttccggccagagcaatatggaaatgcccctgaaaggttttgctggctgttgcatcatgaacggagcggatgacatcatagcttctgccgagaataagggggtgcgtatgttcaccgttcccaagcaccagacttatgaaccgcaaaccgactgcaaaggtagctggaacatatcttccatagaaaccgcacccgatttcagtgcgacggcctactattttgccacttcgttgagccgtgccctccggattccggtcggcatcatctgtagcgcttacggtggatccactgtagaaggttggataagccgtgaactgctggaaaactatccagacatatctctcaaccccgattccatcgaacgcctgcatcccatgctccgccccatgctgatgtacaatgccatgctgaagccgcttcagaactataccatcaaagggttcatctggtatcagggagagtcgaacgtaggtcgccatgaaacatatgccgaacgcttggccgacatggtgcagctgtggcgcaaggaatgggggctgggcgaattgcctttctactttgccgaaatagcgccgtacgcctatggaggtacccagcaagagaaagctgcttacctacgtgaagcgcaattccgtgcccaaagcctgattccgaacagtggtatgatttcgacaaacgaccttgtagagccttatgagatgtacaatatccatccccgcaacaagacaaaggtaggtcaacgcttgagctatctggcattgaaccttacctatggattgaagcagatacactgtttcggcccacaatataagtcatggactgctaaaggcagtgaagcatgggtttccttcgaccatttggaaatgggtatctgtcgcaactatgaccttcgcggtttcgaagtggcgggtgaggaccgtgtgttccatcctgccgacaaagtatggctgcactggcagacgaatgaagtggtaatctcttcagaaaaggtatcccatcccgtcagcgtgcgctattgtttccatgatttccagattggtacgatgatcggtgggaatgaactgcctaccattccgttccgtacggataattggtgaaagagtgaaaagtatataaacactttcattatactataatattgggcgcgggttacgcggaatccacggatgcagtaaactaaatccgtgtaatccgcgcctaaaagaaaatatccagagggttttgttccccctctgtcttttattgtttcagcaactgttctgctgcaagtaccaggaacatatagtgggacgaacctcctcccaacacatactcagtctgttgccagaggaacgggaacgtcaggagttccgggaagtcgggacggataagcgccgtaccggaaatgactccaccgggaatgtacgaccagtctgcgcggttcagtccgtagcctacagtggctgattgtgcgccgacacccgaggcgaaggaagcctggttggagcccgggtggcatccgagaatgaagttgagggcattgaataccggtgctttcgggaatatttccggataggcggttgtcaggaagtagtgctggaagccgaaacgctgtatatcccagcctgcaccccagatgttcggacggtagggaacgccatagggagtctcctgcacttgtttgttcagttcttgttcatatccggtcaaagctttgcggaaagctgctgaaaaggctttggctttcttgttcttcatctgtgcgaacagtttttccacacgtgccgtgtaccagccgatgcggcctatctgcttgatgatgagctcctggttgtccagaatgaagtccatatagggttgttcgccggtggtgaggtacagctctacggctgcctgcactttggggaacaaggctctgttgttgccgcttccggtagaagcatatactttgcgagcaatgtcgaggcaatgcacactcaatgtatcattgaaacctttcaatacacgtgatacggcagccaactgggcagctgtcgacagttcccgtccggggttatcctccgtaaatatccagcggtcgtcttcattaccgattttcccgtcggtcatggcggcggcatcacccagaagtacgtactggcgcaggtcgttgcagatgattccccggtagagacgtcccagtgccaggtagccgttgactaccgtaagggcgccgttctctacttgttgcagcaagtcattcttaccgtcgggctggtggatttccgtcacacggtttatctggtcgatggaagtcacgtcgagattcgggtggaaagcttcgtaggccagtgccaggatataggattctccggcttgggattcgatgcggaggtcaaagtctccggcatcgtgccagccgcctatgttcactccgggaaccacttcacccggtttgaacttggacaggccctctttctggtcgtagccgtcgatatgattgtgtgccggtgccatctgggcatcgtccatgtggcagcagtcgtgccatacgcggtatttttcgttgacgcgcatgtggcacatctgtacgggaaggaagtattccagtacgggttgccatacgccacgggcatatacgtcattgtcgatgcggaagatgggagacacggaggtattgtatttaatcttataaagccccggttcctttacatctgtgaagtttactttcagatagttatacctcaagaatttaccccagttggcaggagtgacgttcttgacaaccttttcgccgtcggcatcaatgcggatgatttgtgccgtttcctttctgttgtcacgtatatccatttcgatgacggcttccttgtcctgagtgggatgataacctatctgtgaagtctggataaccggctgatacatccagtcggccactacgttcggagtgataatccatttgacggcacctttggtgacacccggttttatgttgctgcgcagtacgaaccagccgttgttgtggttcatacgcccgtcaaacagttgcaggtcaccgctcaatgattcgatggtaactttgttgtaagggtcatcgggccgggaggtgaacttggttcctttggcataaggttcgctgatgatgtcgtctgccacaatcgggctgtaaccttttcctatcagtttgtccatgtctgccagcgattttttgccgtcatggtagtttcctgtatgcagatagttgggctgggttgtcatcaggggggagttgggctgttgcgggaagatgccgctctgaccgtccataatccagggcttgccgaagagggaacccgggaagaattcaaggttgaagcccacttttccgatgaattcctggggaatggggcggtcaagatctacggtcacctctatgtttttacctttgctttccacgtttaccgtatatataaggtggaggtccgggtaaatcatcgggttgaatccggtgagatggcgtgaggagtcgggatagcacagcgtggcggtgatgctgttgtcaccgagcttccggtcgagctgtttcggtacgggttgccattgtccgggcgtggcttccaggcggatgtctccgtttgttgccacacggtgtccgttcatgatgatgcatacccctccctggtgtccttcgggatagatgtcatcaaaagccatgacgtcgactccctggttcttgaaataaccggaggatgtcagcttgaagtcttgcgcatgcagcgtactgctgccgcaaagcagtgccaagactgatgcaaataggaaatgtttctttctcatagtatctatttttgagttacgaaattttctactaatatacggactaaaaaggaaacggatggcttttgtttgtagccaataacgttatgaaatgtgtctttttcctctatttttatgatattcattgttatatttgtcatacaatggtgtttgaactgccagataccaacgtttgagctaataaaagctgatgtctggtaaaacaaggactcagtacccaaaaacagcctttatcggaaccaattgtatccattgaaaaaggatggtagtgagtagtggcaacttgtttttttgtacatttgcaatgtaactatgattaattccttaaatcgctatattatgaaacgtatgttttccgtttttttgctgattacagtatggttgctggttacacctttcctgcaagcacagtcacacgtagacaaggttttaaaagatgaaataacctcggacttgaaagagaatatcctctctttttgggaaagatacagcgtagattcttccggaggcttttatggttcattgggacgtgacggtgccccgatagcggatgctcccaaaggtggtgtactgaatgcccgcatcctttggactttttcaaccgcctaccggatgtatggcgatactgcctaccgtaaattggctgacagggcgcaacggtatttcatagaccacttcattgattcgcagtatggaggcgtatattggctgataaaagcagacggtaccccgttggatacgaacaagcagacttacggctgctcttatgctatctatgggttgtccgagcatttcagggcaacgggcaacaatgaaagcctgcaaagagccatagagctttaccggataatggagagcaaagtcaaagatcccgtaaacgacggttatatagaatcctttacccgcgaatggggaactccccaaaagctggggtatgacggagacggcgttgctgccaaaacaatgaatacccatatccacgtattagaggcatacacggctttatataaagtatggaaggataacggccttcgcaagcgccttgcaaaagtaatagacttgataacaaccaagctgtacaacccacaaacacatcacctgatatcatactgtgattcaaactggaacaatctggatgacatcgactcttacggacatgatatcgaaacttcttggctgctgacggaagctgcagagactctgggtaatccggaggtcatcgggaaatgcaggaaggtagcgttagaacttgcagacgcttccttgaaagagggtatcaacccgatgggagccatgatgtacgaacggcataaggacaaaatcaggagagatgcttcttggtggtgccaggcggaaactgtggtaggctgtatcaatgcttggcaactgaccggtgagcaatcttatctggagagtgccgtccgtacctggaacttcatcaagtcacggatgatagacaaagagcatggcgaatggttcagaaccgtactggaggatggaactccgcgctacaaggaacctaaagcaagtatgtggaactgtccttatcataacagccgtatgggatttgagattgttgcaagactgaaatgataaacttcgggtcatccctacgtgtaggagccttgaaaggagatatggagattactggaaaagagaaacaagtccctcccgttttccatcgcgaaaggggcatgcaggcagtgacgactacactgcgcggtgtaaaattaccttattgtcaggcgaataactctaaaattatatgtatcttgccccgtcaggggaaagttgccgtaatataatgatggcgaggtacgtgaatttactgttgttgatactgttacgggtgattgtgtgtttataggtagccggaaggaatggaggtataaaatgtgttctgtaggctatataaatgtgtttgaatatttattcggcaacaattttaccctttcaaagaaatatttgggacactgcagagaattgtaaatctctatatttgcattaattggattctatttatttcatagtatatcaaaatgaaaaaagttctatttgcattatgtgcgattttatggtcaacagtagtgcttgcccaagtacaggcaagaagtaatggttttgtcgtgacagttaaaggggtggttgttaaggtggagttttatactcccaatattgttagagtttcgaagacattggagtcgggcaatgtcaatctgaggaaaagtctggctgtggtgcttgaacctactcaggttgaagtcaatgtttctcggcaaaacgatatggtaaaagcttcttcttcattgttggaagttattctagatttaaatacgggacgtgtccagttcagtaatctggatgggagtaaactcttgaccgaaaaagactacggtgtccagttgatgccgttgcaatatgttcagagaataagggaaaagaaggtggaatctcatgttgctggtgaggttgtacctactcaaagtgctccaggacaaaatactcccggtttggatagaggaaagatgcggactattgttgagaatacttatgaagtgtcgcaatcatttattttggacgaggatgaggttatttacggactgggccaacagcagactggcaagatgaatcagcggaaccagcggttggttcttgaacaaaataacatgcagattgctgtaccttatttcgcgtctgtcaaaggttatggtctttattgggataattattcgattacgacatttgatgatacgcctatggggacatcatttagatcagaagctggtgaagcgatagactattattttctttatggtggaaacggagatgctactgtagcacttttgcgacagctttcgggacaagctcctatggtacctttatggactttgggcttttggcagtgtaaggaaagatataagtcgcaagatgaggtggtggaggttgctgaaaaatatcgtaaattgggcgtaccgcttgatgggataattcaggattggcgttattggggagaggataattcctcttggaatgcgattcagtttctcaatccaaatttttccagacctcaagagatgttttccagtttaaggaagatgaatgtgaaaatgatgatttctgtatggccgagttttggaaatggaacggaaattttcaaggaacttgataaaaagggggcattatatcctatggtttcttcgccccgtgaggcaagagtctatgacgcttttaatccggaagctcgtgggatagtatgggattatatgaacaggtatatgttccagcttggtatgtcggcatggtggatggatgctacagaaccggaattttatggtgccaaacagtctgatttcaattttcagacgaaagaaggggctttaagaaatgtccgtaatatttatcctctgtacactagtaaggctatttgggataatcagcgtgctaccaccttggataaacgtgtatatatattgactcgttcggcctatataggttcgcaacgttatggtgccggttcatggagcggtgatatccgtgcaagttttgatgttttcaagaaacagattccggcaggtttgaatttttcgatatgtggcattccttattggaataccgatattggtgcatggcatccctatggcaatgtttataatacggcacataaggaccctgcttaccagcagctttatgtgcgttggtttcagtttgctacatttaatccgatgatgcgctcgcatggtacaggttcaccccgtgaaatttatcagtttggcgaacgtgggtattgggcttttgatgtgcaggaacaatacattaagttacgttattcactgctcccttatctttactctacggcttggcaagttactaaaaatggttattcgtatttgcgccaactttctatggaagctcctcatgatacatcaacctatcagatttctgatgaatttatgtttggaagtgctttcttggttgcaccggttgttgaagaagatgctgtttcgcgtagtgtctatttgcccgataatactaagtggattgacttttggacaggacagattctggatggcgggcaagtagtggaacgtgccactcctatagagattattccggtatatgtgaaggccggctctatcgtacctttcactaccaatgaggtacaatatgccacagaacggaaatgggataaacttgaacttcgtatttatccgggtgataatggggagtttgtactgtatgaagatgagaatgataattacaattatgagtcgggagcctacagtgaaattcctattacatgggataatgaaaaacgtattttgactataggtgatcggaaaggccgttttgcaggtatggttaagaatcggaaattcattgtgaatatagcaggtagttcttcttcaaaaacagtttgttataatgggcgggaattaaggattgaattttgaatctatcgtttttgaggggtgtatattttgtgcaaatgtgtatttgttttgttgctttattatggagaaatgaactatgaaacaaaagcaggcataaaaatactattttttctcccttatgtttaatctatgctaaatagttttgtgaatgatatttcatagctctttcttgatggaaagaagggcttttgttaaaccaaattatttagtatttatgaaaaatgtaaggaagtatttagggcttgtgtccatgtcgttggtatgtgccagtcctcttgcggcaatggttatacaaccgtttgtaggtgttaccattgtacaacaaaatgtcattacagtgaaaggacaagtgatggatgaaaaaggagaggcgattatcggtgctaatgtcattgtagagggtactgcccagggaatgattactgatatgaatggaaatttttcttttcaatgtcctgttggggctattctaaaggttagttatataggctatttgtcacaaacaattaaagtctcgggaaatgctggtacattgaaggtcattttgaaagaagatgcagaaaccttggacgaagtggtggttgtaggttatggtatggttaagaagagtgatcttacaggttcggtggcttcagtgaatgttgatgagatggctaagcgtaatccggtgaatataggccaggcattgcaaggtgctgctgctggagtacaagtcatgagaaatggcggtgatccttccggagaaaccacaatccggattcgtggtatcggtacagtccaaggttctgccgatcccctttatgtcattgatggtattatcagtagtgcttctatggttaatcctgctgatattgcttctattgaagtcttgaaagatgcctcggcaactgcaatttatggttcgcgtgcggcaaatggagtggtaatgattactactaaacaaggtgacaagaacaagagtcgtatcaactttactgctaatttatcggttcagtcagtaaacaatacgatagatgttgctgatgccgacttgtttacttggggtgttcgtcagagtaaagcggcggatggtaagtccttgaccaatttagcttggggagaacaatatgcagggcaacttcaaactatagattggcagaaagaaatgacacggactgctttgtcgcgtaattatcggttgtcggcctccggaggtagtagcacttccaactatatggcttccataggttatacaaaaaatgatggtaccattatcaattcttggtatgaacggattacagcccgtgctaatgcagtcagcaaaattcgtgactttctgactgttaatactaatcttgcgtatgttcgtactggtagtcacggaggtgggaacatgcggtcatatgctttgacggttccaactatggaccatcttgatgaaaacggtaatttgatgaatgtacctatcaaatatcctgacggaagttatggggtacctttgcaagagatgaatgggggatgtaccgagaggtagtgacaatttagtggcgagagcatacgataatgacagcaagaattttacagaccgggtacagattgattttggtttgacagtggacatcttgaaaggcttaacattcaaaaccaccaacagttacaatgtaaccaataaaagttcttgggattattcacctcgaaatgaacgtaccattacttctgatggtttggataccttttccatggaaatgagtcgtagcagtgattggaatagtgagaactactttaattatattcttgatacaaaagggcatcatatcaatgttatggtaggacaatcattcaatcagtcggtagatggatttgaactaaaaggaagcgctaaggattttcctgcggataactatcgtgacatcgcttctacattgaattctactactaaaaacgttgaaggtgctttgaaagttaaaactaccagtctttcttatttcggtcgtttgatttattcttataaagataagtatttatttaccggtacaatccgtcgtgacggttcttcagctttcggacgtacaaatcgttggggaacttttccttcagcttcggtagcttggcggctgaatgaagaatcttttataaagaatctgaatattttcagtaatttgaagtttcgtattggctggggtaaaactggtagctcttatggtgacggctctaaatctattgcccagatttcaacaagtaagatgtattattattggtggaatggggtaaattacacagaacagatgggagctgccaaagacaaggaaattgatacgaatcttcattgggaaacgaatgaacagaccaattggggtattgatatgggatttatggacaatgccttgaatgtaacattggattattttatacgtaattcttatgatttgttgctggatcgtaatatgcgtccttctacaggttttacttccatttatacgaatgccggtaaaatccaaaataaaggatttgaatttgctgtgaattatcgtaagacttttggtgactggtttgtcaatgtgggagtgaatggttctgcacttaggaataaagtaaaggaagtcggtgatcctatttttgctacagaggcttcgaagggatatgaatgggacaaccattccattattaagaatggatatgccataggttcgttttatggctatcgcgtaaaaggaatttttcaaaatcaggccgaaattgatgctcttaacaatgcgtcttccactggtaaataccaatccggttctacacaacccggtgattactattattgggataaagatggcaatggatatatcaatgcggacgataaggatataataggcaatggatttcctaaactgacttatggtatctctattaatgccaattatcgtaaatgggattttatgctttatggttatggagtttacgggcaagatattctatcgtattcggccatgagtctgtcttccatccataattcaacgggtgaattccagaattgcttacaagaatatataagtaatgcgtggacaccagagaatcacagtaccaaatatgcccgtatgacggtttcggacaataataagaatacacgtgtgtctgatgcttggattaaaaaaggtgatttcttcaaacttcaaaatattcaggtcggttatacctttgattggggaatgagaatctatgggagcattgagaatttattcacgatttcttcctataataaatacggtgatccggagataggtacggggagattgaatttggtgggatatgattcaggccgttatccctatcagagaacttatagtgtgggtattagtttacaattttaaaaaataagaatatgagaaagaacaaaatattatctgttatcggtggattggcagcctttatatttacttcatgtgatggtatatttgatgtggattattatacatttttgcccgaagattatatatttaccaatgaatctactattgaggaggggctattgggatgttacgaattgctttatccgaatagtttcggaggaagttcgtggggggtacgtcctcatatgatgcttgcgaacttacctactttagatgtacaagcttccggatgggattttaattattgcaagtatgagtggactgcttccgagagccagtttcgttattcatggaagtgctcgtatgctgctatcagtcgtataaatagtctgcttgcgggaatggagagtgtcaaggaatccgtatttaaggaagggataaaggcgaaaaatgaagttattgctcaagcccgtgccttgcgtgcgtataattatatttatttaggtaagaactttggacgtgtaccaatgttgatgaccggtgaaaactactcaacctctcctgccaagcctcgtcctgaaacagctgatgaaatgtggaagctcattattgaggatttggaatatgcgactggtgtgcttgattggcaaccgttaaatggccagtatgggcgtataacgaaaggtatgtgtctggcctatttagctgaggcttatatgtataataatgattatgattctgccaagcaaaggttgaagcagattattgatagtaagacttatgaattacttccttgttttgcttcagttcacgatatgggaaattattggtcgaaagaaagtgtttgggaacattccttctataaattctctacaatgaccagtagtgcgagtaaacttactgatgccttgattcagatgggttaccgttgtgcttctatggaacatgcaggttatggctcattctgcttgtcatgggagttttataattcgtttgaaccgggtgataaacgaaagcagtattcgtgtgttgcattgggtgaaaacaatccttataccggtgaagctataggggttgatcctgcttataatgcagagtttgtagggacagaccataatccgaatgtttatacattgaaatattggcgggaacagcatggagccatgaaaaaagatcataactataatccttgttcacttaccatgaaacgatatgcaggtgtattgttggattacgcagagtgctgtttccgtaccaacgatgaggcaaccggttgggaaataatcaagcagattcgcaacagggcgtggggaaatctggaaactgggatgtcgggtgaatatgtgtttggttttgaggatctttcttatgtaagagatgattataaacttaataaggtaaaagtagaggtacctgatgctaagagcttctataccagatataaggcagaaaaaggatatacggcagatgtatggttagtggctctgacgattgaacgccgtcatgagttcaacattgaatttgaattgtggtatgatttatgtcgatcgggaatggccgaacagtttatcaattgcgaatatccgatgaatgaaggttggacgaaacgcgattttccgttctatgactactacatgctttttccgattcctacggatgagattttgaataatgatcttattaatgaagaagaccagaatcccggatattaaaaataataacctataaatttttagtatatgaaacgattgaggtgtatttgcattttactgtttttgtttagtctggcttatgctcagcaagcaaaatatgtattctattttattggtgatggaatgggagtaaatcaagtgaatggtacggaaatgtatcttgcggagcaggaaggccgtattggagtaaaaccattgttgtttactgcatttcccattacgggttttgctacaacattttctgcttccaattctgttactgattcttcggctgcggggacagctcttgccaccggaaaaaaaacatataatggagctattagtatggataatgaaaggaatgtccttcaaactgttgctgaacaagcgaaaaggtccggtcggaaagtgggcatagcaacaagtgtcagcgtggaccatgcaactcctgctgtgttttatgctcatcaaccggatcgtaacatgtattacgaaatagctctcgatcttccaaaggctggattcgacttttatgcaggtagtggctttttgaagcctgcaacttttgccaatgggaaagaagcaccaacagtttttcctgtctttgaggaggctggatatgcgatagccagaggtctggatgattttaaaataaaagctgcacaagccggtaagatgattcttatccagaaagatggtgcatcgccttccagtttaccttatgctatcgaccgtaaggaaggggatatgacattggcacaaattacggaaagtgccatctctttcttgaccaaggaccgggataaaggtttctttttaatggttgaaggtgggaaaatagatcatgcctgccatggtaatgacgctgctactgcttttgaagaggtcattgatatggataatgcggtgaaagtggcttatgagttttacaagaaacatccgaaggaaactttgattgttgttacggctgaccatgaaacgggtggtatgggtttagggactatcaaatacgagttgtcactgaaatctttggctagtcagaagcaatctcaagatatcttgtcgcgttatattacaaacttgcggaaagataaaaacaataaagtttcttgggaggatatacaatcattattggctgataaaatgggcttctggaaggaactgccattatcttgggagcaagaaaggatgttgcgtgatgaatacgaactttcttttagaagaaggaaagctgtttttgaagagactctttatgcacgtactgaacctcttgctgccgcagccaagaaagtgatgaaccagattgccatggtggggtggacgagtgtaaatcatacagctggatatgtaccggtttttgctataggcatcggttccgaactgtttaaaggaaagatggacaatacggaaatcccgaaacgaatagcgaaagctgctggatataaatgacaataggtatggaaaaggccattctaattcaaatgattggaatggccttattttttagctgttatttattgaatagaaatcagtcgcagactctctgccggaacctgaaccctactgtggcttgtatacattgataagattgatttcagtattcagaggtaaattctcagaggaactgcctaccctgatgatggcaggaccttcttcgaaagtccaaccatgtttcttttcgtcccaatggcacaactgttccagaggtatggagatagtaatttctttactttctccggcttttagggctactcgctggaaacctttcagctcgtgtgccggacgttcgatggcagattgagggcgtgtgatgtagacttgtgctacttcttccgcattcatttttcctatattatctaatgtgaaactgacgtccacttggcttttgttgattttggcttgcaacgctgaatattggaaatttgcataagagagtccatggccgaatggataaagaggagatatattcttagtggcataccagcgataacccacaaagatgtcttcggcataatcagcttcggctttttgctctgcacggaatttatctctgtttacgaggtctacgaatacatcgcgtggcctttctggttgttgctgagggtaaacccctaaatgataggctggcgaatcttccagttttataggaaaagtgaaaggtaatttccccgaaggcgaaattttcccggacagtacatctgctaaggcatgtcctccctctgagccattaaaccaagatactagaatacttgaagagtttttttctattgtctgcaaatcaacaggaccaccaattaccattaccgaaacaatgtttggattggctttggctatgttctgtattaattcgtcctgatgcgatggtaaagtgatgtttttgcggtcagaaccttctgtttccacttcgcggttgttgcctccgacaaagatgaccaagtccgcctctttggctaaggcaatcgcttcttgaaccagccgttcgcttttttctctgatttctttctctgatgaggctgtttcgctgctgttgcgcttgtgccgtgaggaacgttcctgcggcaggtaaccttgtgcatacttgattttgacattggttccctcataagccttctgtagtccttccaagggtgtaatttcatataaagccttgacaccggcacctacaccgcccgtagccatatgccggactgcattgtctccgatgacggctatgtccttcactttttcggtgtttatgggcagcagtccggagtttttgagcaatacgatgcttctggaagctacttcataggcaatctgctgctgggcaggcagggaagtcatttgggtattggcttcttctttgggaacagccgggatagccagccgcacacgaagcaggttccttactttctcgtcaatgactttttccgagacgacaccggcttgtaccgaatcgagcaatgccttaccaaaatatctgtcgttgggcatctctacatcaagacctcccagtgcagcttttgtggtggagtgggtgcctccccagtcggaaatgacgatacccttaaatccccattcaccgcgtaggattttattcaggaggcggtcattctccgagcaccattcacctgacactttattgtaagcagccattacaccgtaggcattggctttcttcacagccgcctcaaaaggggcgaggtaaatttctctcatggcacgttcggaaacttttacgtctacgaatccgcgcatgttttcttggttgttcagtgcataatgtttcagacagacagcttcctgatggtcttgtgcacctaatgtatagttgacagccagttcaccactcagtagggggtcttcacttaaatattcgtaagtacgtcctccggttgggatgcgttgtatgttgatggccggccctaagatcatgtctttaccccggagtttagcttcggcagccattccctctccgtatttgtatgccatttccgtgctccatgtagctgcaagggcagagcctgtcgggaagaaagtggcggaatcggtgcttaaatgcaaggagttccatgaatgcggttccatttcttcgcgaatgccgaagggaccgtcggcatattctatgtcaggtatattcagacgttcgacacctgccgatgaaaacatgttttttccgtggagcatgtttattttttcttccagtgtcatttctgctatgatgtttgtgatttcgtcctcgtgttgtgtcaggggattgaccttttcattggtaggactacatgcagagaaacatcctcctatgcaaattagtaatgataatgttgagtgtttcatggtatgatttttttattgttatcttgttgtcaatgtaaaatggaggatactgggagcatcacctacttgcggtcctccccagtctgtctggtcaccgttgaggatacggagcattttgaaatcaccgttctcatcatagaatccttcttgtactttcaggtactgccaggcttttccttgttttttccctattggttcgaaagtgaaccggcaattagtaccgataccgatgaattcgttttcgccaagttggataatcatggcctttccgttgaccggacgcttttcggcggcagcggtttgccctccacgggtgttgccgaatttgatgatggctttccaactgcctaagctgacgtactgttctgaatggtcggaagactctatgacagggtgtatcctgtcttctgcactccattcagccagcaagtgtgccatcggttttagtatttcatattcagcggataagggggattgcctttgcatgtctggagaaaagttcctccgttggtctacgccgaatggggaaaagccgattccttttgcgatggtatgataaaggaatctcgggcttccgatggtttcgggaaccattaatgcgttatcggggcgggcatatagttcgagcactttcaggaccgccttgtcatcacggaggtagatgtccggagcgacgaagtcgatgtcaggggctgcggctttccagatggatatgacattgtccgttacaccgccgctttcatagtggtctgctgtgggattcgtcagaggatctcttaaggcaacattgatgtataggggaagcggataaatttcttttcctgctttggccacataattgatataacgggctacgtgccatgcatggaaatattcgtctgcccgttcgccaaagacttccttccagctcccttttgcatttttcggtacattcagttctttacaaacagtgggtgtcagaatttcttggggaatggagccttcgaatagtttttgggctttcttcgaatagtctcttacgctgccccatgtccccggttcattctccacttgtaccatgatgaccgtatgttgtgtatctgcttccttcagataacccatgaatctggcgaaagctttggcatccgctttcatcgcttcttcacaatgcggactgggagagtctacttcttgaccatttttgccgataacattgggatacttcttagaatctgttttcatccattcgggcatgtagtgattgcttccgttcttccaggtggcaaaccagaggaagataagtctcatattgttttgccgtgcctgatttaatactgactgcacttgtgagaagccgaacttaccttcttgaggttccagttgttcccaatataccggtatttccaatgtgttggcatgcatttctttcatcacattccatacattgggcagcatggaggcccagttggatgagtttccgcattgtcctcccagaacaaagaaaggtttgttgtccaccaagagtgtgtaacgtccgtttttctgtataagcttggggatggatgtgtctgtttgtgctgacagccacgttgtggtaagtagcatggcgatgcaaaaagcccatgccttgtaattggagatttgtttcatgcttgttgattttgaaaaggttattatttggcaaagatgctgattcttttcgtgaaacggctctctcttttgtgtctgataagggaggataatgtttcccgtttattatttgttggcaataactgtttctgcaagcataaaccggagtaaaacctattcttccggtgtctcttcagcatcttgttccggatactgtccatcttcttcttcttcgttggtttgtatttttctgctatgttgccttatgaattcggaagggctgatgttgaactcatctttaaaatgtttggagaacactttgggtgagttatagcccaatatgtaggcaatctctgagatttgcatctggctttctgtcaggagttgttgtgcccgtttcatgcggatggtcctgatgaattcgatgggtttctttcccgttatcttaatcatcttcttgtagaagtagctgcgtgatatgttcaggctgctggcaagttcctcgacggaaaattccgtttcatttatattgtcttctacaatggcgatggccttttctatcaattgctggtcaaggggggtaatggtgatgcggctgggttcgatctttatctcctgattgaagatttcttgccgttttatattcatttcaatcattttgcagatacggagttttagcacttccatgttgaatggtttggtaatataatcgtcggcaccggtttcgagtccttccaattggtgctcttcgcttgctttggctgttaaaagtattatgggaatatgagaataacgtatgtcttttttaatgtttgaacacagttccagcccatccatttccggcatcatgacatcgctgattattaaatctgcatcttctttttttaagatggataaggcttgttttccattgctggctttcagtatatgatattgtttggaaagactttcagagagaaacttgagaaagtcgtagttgtcgtctacaagcagaatagtggattggcgagattcttcttctgccgattgcattttgattgtatcatcttcttcgattacttcactgttttggtgtaacgggaatgtgattaaaaagatagatccgcaaggatgattgtctttgacactgattttgccatgatgcatttttatatattcggaggcaatatgtaacccaatgccgctgccttcgctatttgccggatttttgcttgactgataaaatcgctggaatattttctccttgttttcgtcttcgatgccgcagccggtatctgcgaatgtcagttccagatttgattctttcacctcaatattcattgagatacttcctttgttaggagtgaacttaaaagcgttggttagtatatttgtacagattttgcgcattttgtcataatcaaaatccataaaaacagagtgttgcgggcaagtgagagtatagtttatgctccttttttgtgctatcgggtcaaaagagtagaatatttcgcttagaatgatgaggatattgtcatgtttgcatttcaggctctcggctttggcatccagttttctgaagtccaacaactggttgatgagttccagcaagtagttggcgttctgctttaccatgtcaagtatgccttttcggtgttcgggatggttttcgagaaattcttcaagcggattaataatcagtgataaaggggtgcgtagttcatgacttatattggcgaagaactgtagtttcatgtcattgattttttgttgtttttcattttctatttcaacagtttgtagaatcaatttttgtttgtgacgcatgcgcaggcttcgaataaccagtaagattaggcacatggcgatacatgtataaattgtgtatgcccaccaagtgcgccataggggaggaaggatattgattttcaattctttgatgtttggactccaaatgccttgtgagttgcatgcttttacagataatgtatagtctccggcaggcagcatagacagattgaccttattgttgtctgcgtacacccagtcaaagtttctttggttaattttataggcatattttattttgtctgtttctgcaaagtcaagtgcagagaaagataaaatgaatgaattttctttttcagtaaaagaaagggtctgtgtgcattcaagtgaactttcattcgataagttgggatggtatattcctgatttgagttcaatccctgtcaggtagatgtttgcgtggtagtctgttgctaaaatttcttggggaatgattgtctgatatcctttgggggtacctattaagatattgccattgtccaacttgagtatagcatgtatattggtatcattgcatattaatccgtcttttatggtataattcacaatgtaatattttccatttactatttggactcgtgaaataccgtttcccgtaccgatccacatttgtttgttgttgtcttctataatagctttgacgaagttggtggcaagcccactcttctggtcaagaaaaaggatggaatcgttcttctggtcccagacacttattccatgtgaatggcctatccaaagaaggttgcggctgtctttgtagacagtaaggatattcttttcgctgaagtggttgtcttcatcgaaaaggctataggtttggttttctgtatcaatgatgatcaatcctccgttggaagctacataaagatatttgtcgctgtcatagtacatatctcggatgaaaaactctccggggcgatacagaactgtgtcgaactcttcggtttcggggttcagcctttgaacgtaacctctcattgtccctatccatatataaccatatttgtcgacttttactgtatatacgttgttttcgagcaagtggctgttgcttactgtatactgtttgattttcccttttgagtagcacaagagtcctttctgataagttccgatccacaaacggtctttggagtctatggataaatcaaccacaatattggcaggggttggtattttttcatataagtcacttgccaatgattggcggattaaacctgtaccatccgtaccgtaatatataaattcctgatcggtatctttacagaaggtcaggatgtcattgtactctggagacttgttgcacagtatgatttgagacatcggactgtaataggatatgccgtgtttaaagttgcctatatatacaattccatctttgtcttgatagattgtactaaggttgttactggcaatggtatgctgctttagaggggtatgggtcaggttggtaattgatttgttcaaggtattgtatatgaataggcccttgtggctggtaagtatccatacgtttccattgcctatgtccaggatgcgttgtatccggttatattgcatgtcctggccattgtttaactttatttcttcccattgccgggtgaagctgtttttgtgcaatagcaggctgttctggtatgtatataaccatatattctcgttccggtcggtataaatatgaggctcatggtttttcaataaaggtatgaatgttgtagggatggcgatttctttggtttcagaggtctgcttgtctatactgtataatgcgccgtcggagtacattatatagatggactgtactgcaatagatatgtttgagattttttcagtttgtaggggaaaaaccttgatggggttcttgtcttcattttgtaaatagagcttgctacggttgtaggcccagaattcatttttgggagtcatgcctattctttgaatgtttttgcttggtatatgtttcttttcaagtacggacttgtaatcgttgctgattttccctgttttatagtcataaatgctgtattcgttggctgttttaatccatatgttgccttgcggcccttcaaaaacttcaaagatggcatcatcggatagtcctgaattactttgataatattgatggaatgagtaaccgtcgtatttgttgagccccgattcagttcctatccacaaaaagcctctactgtccctgaagatgcttcggacactattgttggagagcccttctgatatggaaagttgtttaaacatcatggttagtgttttctcgttcgtatttcctgaagtggtgagtataacacacaagatataaatggcggttgtgaataggcgcttcatgtatttcttagttttaaattaggaaggttaacaatatcataatccaaaattaaaaataatattctgattaggcaagactatttttgtgtatatatggaggattatgtcatttgtttgttgaaaaataatgtattgtttgtttccaaaggtgccgaaatgtgcattgtgaaacaaaattgggtattaaaagacatttttataacctatgtttcgctttggaaaggaatatatttggcagcaaaatcacttaattctaatattatgataaagaaaattttaacggtggcgatgcttgtgtgcacttgcagtagttcattggcacagccacatgtcaatgatggtacttcgtatttgatgaatcaggctttggatatgagtacggacttccttgatttaagtaatactttattctttgcagaccatctggaatcattcgacgttaagtcgggtgaaggactggtgaattggaaacgggggcatttaatgccacgtcaggctttcaataccaacggtgcgcaaccccgtaaaatgagaatgctcgattttccttttactgcttatgagaatgatccgaacttaaaatttaagattgactttgtaactccgcgtacagtacgtattcgtatgcttactactccagtggagcctaaggtaagtacatccattatgctggcgaaggaaccgggtaaagatgaaagttggaaggtaaccgaaacggaaaataccattgtctatgccggtaattatggaactgtacaaataaacaggaatccttggagggttatattgaaagataagacaggacgtatattaagtcaaaccgttactttgcgtgatgctgattctacgcaagtgaagtatacccctttcagtttcattaaaagaggaagcgacaatgctcgtcgtatcaatcccgtgtttactctgactgcagatgagatgatttttggctgtggcgagtctgctacagggttgaacaaagtggggcagaaagtaaatctgtttgttacagacccacaaggtccggaaacagaccagatgtacaagcccattcctttctttatgagcaatcggggatatggtatgttcatgcatacttccgcacctgtcacttgtgatttcggtgctacttatatcgggctgaacaaaatgtttatgggcgacgaaaacttggatttgttcgtattcttcggtgagccgaaagacatcttggatgagtacactgatttggtaggaaaaccgggtatgcctccattgtggtcttttggtacatggatgagccgtatcacctatttcagtgaaaaagaaggttatgatgtggctgctaatatccgcaagaataagtatccgtgcgatgttatccattttgatactggttggtttgatgtagactggcaatgcgattataagttttctgaaaaccgtttccagaatccccagcagatgctgaaggacctgaagtcgcaagggttccatgtttgcttgtggcagttgccctattttactcccaagaaccgttatttccctgaactgataaagaaggacatgtatgtaaagaatggtaatggggaacttccttatgaggatgtggtgctcgatttctccaatccggagactgtagactggtatcagaacaagttagccggactcttgaatatcggtgtcagtgccatcaaggttgactttggcgaagctgctcctctgaacggtatttatgcctctggcaagagtggttggtatgagcataatctctatccggtgcgctatgacatggcagtatccgagataaccagaaaactccataacgagaacatcatgtgggctcgtgctgcgtgggccggttcacaacgctatccgttgcattggggcggtgatgctgctacgacgaatacgggtatgctgggtacactccgtgccggtttgtccttcggtttgtcgggtttctctttctggagccatgatatgggagggtttgtaaaatctactcccgaagatctgtattgccgttggttgccgttcggttttctgacttctcatactcgtgcacacggtgcacctccgacagagccgtggttgtacgacagcaagcgtgtacaggatgttttccgcaaaagtgcagagatgaaatatcggctgatgccttatgtttatgcccaagctaaggaatgtaccgagaaaggtttgccgatgttaagagccttgttcgtggaattccctgatgaccctggagcatggaaggtggacgatgaatatctcttcggttcgcagattttggtcgctcctttgctcgaatcaggtataaccggtcgcaccgtttaccttcccgaaggaaagtggatagactatcagacagagaaagtgtatgaaggcggatggcataagattgaagcaggcagcttgccgataatcatgctggtgcgtgacggttcggtgcttcctcatctgaagttggcgcagtccacctctgaaatggattggagcaagatgaacctgaaagtgtacagtgccgataagaaacaggcagagggcttgatatgcctgcctacagacaaccgcattcaggtagtgaaagtggattgcgggaaggcgaaaccgcagttgctgaaccaagttgaagggacttccctgaacttttgaatttgatctttaaaaacctatatttaattcaccccttgtcggtatggaagagaaagggatatagttaccaatatctgtgccactatggtggcacagatgtgccattactacggcacggcagtgcctctatgttggcacagaattgtgtcgcgtgtcttttcccccgatatgctatgactggggtatttgttaaacctaagtatttaatattttatgagaaatgtgatgaagtatttgggtatcgtgtcagtatcgctggcatgtgccggacctctctttgcaatgggtgtacagccgtttgcaggtgtctctgtagtacagcagaatgttgtcacagtaaaaggacaggtcgtagacgagaaaggcgaacctgttattggtgctaatgtcattgtggaaggtacgaccaatggtatgattacggatttggatggtaacttctctttacaatgtcctgtaggctctacattgaaagctagttatatcggttatttgacgcggaccgtcaaggtaagtggggcgatgaatgcattgaagattgttttaaaagaagatgccgaaacattggaagaagttgtggtggtaggatacggtacgatgaagaaatccgacctgaccggttccattacttctgtaaatgcagaggagatgatgaaacgtaatccggtgaatctgggacaaggtttgcaaggtgctgctgccggtgtttccgtcattcgctcttccggtgcgcccgatggaggattcagcattcgtattcgtggtgtagccaccgtaaatggtagttccgatccgctttatgtagtggatggagtgcaagtcggtacttccattgattttcttaatcctaacgatgtggaaagtattgaaatcctaaaagatgcttctgctacggctatttacggaacacgtggtgccaatggtgttattatgattaccacaaaaagtggaagcaagggtaaggcaaaagtggatttctccgccaactattctcttcagttcaacagtaacaagatagatgtggccgatgcggacctctttgctaaggcagtgcgtgagtcttgtcgtaatggttcggttatgaccaatctggcttttggtgaagagtacattggcaaactgaataacattgattggcaggatgaaatgtcgcgtacggcattgcagcagaactataatctctccgcttcgggaggtacggaagctacacaagccaatctttcggtgggatatctgaataatgaaggtgttgtcattgaatcttatttcaaacgtttgacagctcgtgccaatatcacccataaagtgaaagatttcattcatgtgggattgaacttgaactatacacatgcccagcatcattttagtggcaatatgcgtagttatgcacaagctattcctacgatggattatgtggaaaatggaactttttattctatgcctattgttttgcccgacggttcatggggacattataaacaagagtctgatggtgatatcaacaagggagccgataacttggtggctgcagctaagaccagaaccgaccagatttccaaatgggaccgtttggtggccagtgcattcttgcaattggatattgcgaagggattgacctttaaagctatcggtagctacaattattctacatcaggttatgatgggtatactccctataatccccgtacattcggttcgaaagaccgtaaagatagttactctatcaaccagaatcagaattcggagattgctttagaatcgtttgtgaactatgattggtcgaatgatcatcatcgtgtcagtgccatggcaggtttctctgttagcgatacggacggtgtttggttgaataccagcgccagtgatttcccggctgataatatccgccagatttctttgacaaacgatccctcttccaaaactacgaatggtggacgtgatttgaaaacccgttatcaatcttattttggacgtttgacctacagtttgaatgaccgttatatattgactgctacagtacgtcgtgatggctcttctaattttggatcgggtaaccggtacggtactttcccttccgcttctttggcatggcgtttgtcagaggagaatttcatcaagaatctgaatcttttcagtaatctgaagatacgtgccggttggggacagacgggtaatgcaggaagtgcgaccagtctttctgttcctcagctctcttccttgaactgtatgtattatatgatgattggaggcagtatgactaatggagctggtatcgcacagcaaaaggaaattgatacaaacctgaagtgggaaactaacgaacaaaccaatatcggtctggatatggcctttatgaacaacgagctttcattctcggttgactactttatccgtaactcgaaagatttgcttatttatcgtcagatccgtccttctaccggttttacttctgtgtataccaatgccggacatatccgtaacaaaggttttgagattagtgctgcatggaataagagcttcggtgattggaatgtaggagtgcgtgttaatggttctaccttgaaaaatgaggcggtagaggtcggtgatcctattttttacaaaaacaacagttctggtggtacgcaggatggcgatgattgggataaccattccatcacacagaacggttatgccgtaggttcttattatggctggaaagtagccggcattttccagaaccagcaggaaattgatgccttgaacgcccagtcgcctacaggcaagtatcaggatggtgacactgctccgggtgacttcaagtatattgaccttaatggtgacggccagattacagacgaagaccgtactgttatcggtaatggtttccccactctttcttacggtttgaaccttactgcctcctataagaatttcgacttttcgatgaatatgtatggggtagctggtatggatatctattcttatagtgctgcccgtctgacttctatgtatggtcctgatggtggctaccagaacgttctggcagaatatgtgaagaatgcctggactcttgagaatcccaatggtaaatatccgcgtatcaccaaaggcgaccacaataagaaccaccgtgccagtgacgccttcattaagaaaggtgattatttgaagatctcgaacattcaggttggttatactttcccgaagaatttgataaagcatgcgaagatggagaatgcccgcgtatttgtcagtgcagataatatattgacgctttcttcctataataaatggggtgatccggaagtcgggtcaaacagagtgttgttgacaggattcgatggcggacggtatccgttcccgttatctatttctttcggtgcgagtgtacaattctaaatacctaacagataaacagatatcattatgaaaaaaagtttttatcatatattgttgctgagtgctctaaccttgggtaccaccagttcctgtgatgactatttggaagtagatcattacgatattctgcctgaagatttcatgtatcagaatgaaacaaacataaagtcggggctttatggtatatacgatactttttatacttatcaaggtagtgacaacagtggagatgatacaacatggggattcaaacctaatgtatttattgcggggcatagtacgatggattgtcaggcatccggctgggatgccgaatggcagcgtcatgcggtattggccaataaaggttcgctggatacggcttggcgtatgagttataaagctattgaccgggccaatcgttttctggctggattgcagaatgtggacgtttccgtgctttctgtcgaaaagaaaacgcagtttgaagctgaggcgcgtgccattcgtgcatataattacttgtatttgtcaaaagtctttggtcctgttcctatgttgcttacaggtgagacttatacaaccagtgcaggaaaggcgcgtcctgaaaatttggagggcacttatcaggttgttgaggaagaccttaagtttgctatggaaaagttggattgggaacctgccgatggagaatacggtcgtattactaaaggtttctgcaaggcatttttggctgaactctatatgtatcagaagaaattcactgaggccaagaaggagttgaatgatattattgctagtaatgtatatgcattggaaccatgttatgccaatctccatgcctgggacaaccattggacaaaagaatcggttttcgaggttgcctatcatactcatggcaatatgaattggggaggcaacagcaacgatgacggtaagatatggtatggctatatgtgtgccgctcccgaatacggtggttggggatccttggctctgtcttgggagtattatcgctcttttgagcagggggacaaacgcaaggaatacacttgtgtaggtactggtgacacacatcccattaccggccaaaagctggggcttaatccctcttacagcggatatgtacaaggttctgaaaatgtaccttgcgtatattcgttgaagtattggagaaagcaaccgggtaaggacgggtttgtgtattgcccgatttcattgactttcaaacgatatgcaggcgtattgctggattatgctgaatgttgtttcgagacgggtgaggaagcgaccggatgggagatgatcagacaagtgcgtaatcgtgcgtggggtaacttggaaattggtgtacaagccattgatttcccgcaggcaatgttgaatacgacagttgtcgatgtacccgatgcaaagactgtttatgctgaatataagacgcggaaagggtatacaagtgatgtatggaaagtggctttgacacaagaacgccgtcatgagctcaatgcagagttctctttatattttgacctttgccgtatggggttggctgaagaatggttcagatgcgaatacccgaaaacaaaagccaattctacaccggaggagtgctgggaaactggcgattctttccgttattttgagcatcagaaatatcaggagattttcccaatacctactaatgagattcttaataatcctctcatcaattcggaggaccagaatgagggatattgatgactctaaaattgtgctaagaatagacaattatattgttctgttattctgaacgaagtgaagaatctcttctacagaaaagagattcttcactatgtttggggtatgtattcctgaatgagcaaatcagatgattaagtgtccacaatttaaacttgtagttaagtatggcaagaaaaacattttgtttccttctatttatatgtatgggcgtgtgtgcatgtactgttcggcataattcgttacggtcgacattgtgtgcggaaattgttgccaatgtccgggacagtgtactgccattttggatggattatgcagtggcgcctgacggcggtttttatgggactgtattgcggaatggtactccggtggtagatgctcccagaggaggagtgttgaatgcccggattctgtggagtttttctgctgcataccgtacatttggagatgaatcttatctgaaacttgccaacaagtctcagcgctattttatcgatacatttattgataagaagaacggtggggtgtattggttggtcaaccccgatggtgaagtagtgaatgcttctaagtatacttatgccatgacttatgctatttatggattagcagagcactatctggcgacgggtaacgacgaaagtctgaaaactgctattagtttgtatcatgtcttggaagaaaaaggtcgcgaaccgcaatatgacggttatgtggaatcctttaccgaaaattgggaaaaattggagcaatatgataataacgctcctaagaccatgaatgcccatctgcatgtgttggaagcttatacccttctatatcagtgctggaaagacaatggcttgaagaaaaggcttgagttttgcgtcgatttgttcatgaaccgcatttacgacccgtcaaggaagcatttcaatctgttctttgataatgagtggaacagtctggtcgaaatggattcttacggacatgatgttgagaccggatggttgctttgtgaggctgcccgtacgctggaaaatcaggacttgatagaacagacaaatcagcttgcattggatgtgacggaagcttgtctggctgaaggaatgagtgataaaggctatatgatttacgagaagaaaggtgacagaaaaaccaagcatgcctcatggtggggccagattgaaacggtgatagcttgtgtcaatgcttggcaaatcagcgggagtgacgtttatctacaatcggttgatacggtctggacttttgtcaaagaccatatggtggacaaggaatacggggaatggtatagcgactgtttcgacggagagcctaaaaaggaggctcccaaagtaagtatgtggcgttgtccatatcatacggtacgcttgggagtggaaatgtataatcgtttaaaataatacgtatgaagaaattgataataggtgcggcatcactgatgctttgtgcaggtttgcaagcccaggacttcaagattaacccgtcggggtattttgaaaaccacggggccaatgtgatggttttcagtgatgtctatcctgaaggacaccaagggggtgtcaccttggttttgaatggagaccgcagggccgcaggcggtgatgtgcgtttcgagatttcgcaggggcagtggcagggattgcccaagatgaggaaacgggtggtggatgaggctgccaacgaaatccgtgtcacactgagctatcctgactcggccaagcatatggcggggttcaatccgatgctctatccggattttgctttcggctatactatcaaggtgaaaggggaaaaggactatctggtattgactgttgatttggaccggccggttccggagcgctttgccgggaagctcggtttcaatctggagctggtgccttctaccttgttgggcaagccctggattatggataaccggacgggtgttttccctcatcaggcgatggggcccaccatgaagcagacctccaatatggagcatatcggagacttcaatcctaaggggaaagccagcctggaccagttgcttctggaccggaagacttataatccgatgattgccgatgatattgtctctgcccctcttgccgcgggaaaaaagtttgtgctcaatccgcaggatgagttggcaaagattacgattgagagtgagaagggagatttgatgctgtatgacggacggataaaccataataacggttggtttgtgcttcgttcggaatttccggcaggaacgaaagggaatgcggtgagatggattatccgtcccacagttaccaaggagtggcgctatgcaccggtagtacagacttcccaagtgggttatcatcccggacagaagaaagtggctgtcatcgaattggacaaacgggatacagatttccggcaacctgccctctaccgtattgcggccgacggcaggaaactggtgaaacagcaggctgccaaggattggggagatttccagcgttaccattatttgcagttcgactttacggaaattacggaagagggactttatcaggtgatgtacggtgatgcggcttctccggtgttccgtattgcaaaggatgtttgggataaaggaatctggcaggcggaggtggaatatttcctgccggtacagatgtgtcacatgcgtgtcaacgagaagtatcgtgtatggcatgacttctgtcaccaggacgatgcccgaatggcccaaacgaatatcaatcacattgacggatatagccagggaccttctactctgtgtaaatatcagccgggcgatcttgttccgggattgaacgtaggcggttggcacgatgcaggcgattatgacctgcgtgtggagtcgcaggcaggtgaagcctatatcctcgctatggcttgtgagaatttcggtgcctactgggacgagacttccattgatttcgaaaaacggattgtagagatacaccagcctgacgggaaaaacgacttgttacagcaagtggaaaacggggctttgaccgtagtagccggttggaaggcattgggacgcctctatagaggaattttgtgtcctactgtacggcaatatgcacacttgggagatgcttcggcccatactgatcatgtcagtggaacggctgatgaccgttgggtgtttacggaagacaatccgggacgtgagttacaggtgaccgcttggctggcaggtatttcacgcgtgctgaagggacataatgatactctggcggcagattgtctggaaatagcccgtgagctgtttaagattacacgttgtgataacaattggatactgacaacgaaagtacatgccgccgtagagctttatctggcaacgaaggaagccgggtaccgcgatttcgttttgcagcagcaggatttcatctgcaagaatatccgtcagacgggctggttcatcggacggttcgaccaggctgtgggcaatgtccgtttcagcaaggctattcgtaaggcattgccggagttacaggccatgtatcaggagtatagcagtaaaaccccgtatggagtgccacacgacagaggtaaccgttcttccggttcatgggagcctcagcatttgggctataactactgttatttacatgctgcttatcctgacttatttacaccggactacatttttaatgccgtccagtatctgctgggtatgcatccgggacgtaaccaggcagcttttgtaacgggggttggtgccgaaacgatgaaggccgcctatggtgtcaatcgtgctgattggtcttatatcccgggtggagtttctccgggtactaatctgattcgtcccgatctaccggaactgcttcattttccgttcttgtggcaggaaggtgagtattgcctgggtggacatgctacgtggtttatgtatatggtattggcgtctaataaaatattgaattgcaatgaatagtaaaataaaggtagataagtttgtaattgtagtttttctgctctgcatggtttgtaatatgaccatgcaggcaaaagcttacgagagtttcaaagtatccatttatgtccgtgcttacgaggtagacaagatgaaggacatccattggctggattctacctggactgtgatttcacaacagttggaagtggacaagatttatctggaaacacaccgggacttgctggtcgtggaggatgccactctggaacaggcaaagaaattctttcatgaccggggtatagagacagctggaggtattacctatactatcaacgaggcaaacagtttcgagacattctgctattccaatcctgaacaccgcaagatggtgcaaaagattgcggaacacacggcgaaacactttgatgagtttattctggatgatttcttcttcaccagctgcaagtccgacatagaaataaaggcaaaaggaatgcagagctggacggactaccgcttgaagctgatgaccgaggccggtcgtgacctcgtgctgaaacctgccaagaaagtgaatcctcagataaaggtgattatcaaatatcccaactggtatgatcactttcaaggtttgggatttaatttggaggaaggtccccagctctttgacggtatctggaccggtactgaaacaagggacccggcaggtaatcagcatttgcagaactatctgagttataatattatccgttatttcgataacctgcgtccgggttataacggtgggggatgggtcgatgtaggtggactgaacatgggtatggaccggtatgccgaacagcttcatttgaccatgcttgccaaggctcccgagattattctctttgcctatcaccagcttctggatgtgaagttgtctcctaaataccgtactccctggcagggaatgggtaccagctttaactatgatgaggtgactgctcccatccggttggaagacggctctttggtagaacctaccacgatggcccgtatagccggtgttgtgctgaaacagacggataagttgattcataagctggggaatccggtgggtataaaatcctacaagccttttcatgccgccggtgatgatttccttcagaactatttgggcatgataggtttgccgatggatatgcgtcctgtttttccggaagaccagcaagtggttctgctgactgcacaagctgcacaggatacggaaattatggctaaaatcaagagacaactacaaagcgggcgtgatgtggtggttacgagcagtttgctgaaagccattcctgagaagcttgcagaggtagcagagttgcgttgtactgatttgaaggctcttgtcaatgatttcggccgttacgggcagtccggacgtgacctgttgattccgcaggtgcagtattatacgaatgatgcttgggagatggtcagtgccggtcgtccgctgacgggtggagtttcgggctatcctattctgttgagagccccgtatgctaccggtaatctgtatgttcttaccattcccgacgatatgggcaatctgtatgattttccggccaatgccttgaatgaaattcgtcgcattatgagtaaggacataggagtctgtctggaagctccctccaaagtaggcctgtttgtatatgacaataaaacgctggtggtagagaacttcaatgacgaaccggtagaggtgcgtatcgtgaccggtgataaggtgatgaagctggaaagcttggaggatgggactgttttgagtcctcttcctgccggaccggtgatacagaccagacgtccggttacgcctaagaattctttccgtttattactgttgccccattcatataaggcattccgatataaataatgggtaagaagattgccgggtgactatttgaaagagcaaggaggctggtttactgtaaaaccaacctcctttgcttattcatgagcatgcttatgctctcccagtattctgtgtggcagtgttccgtgtcccaataactctatcgggcagttgaagttccgttccagccactcctccgtgacaccggtgtcggggtggtaatccagcgtttcgttgacgcaagcgatagacttgacttgctgcaataccgtaccgatgtcatggctgacgaggatgatggcacattcttcattgatttctgtcagtagttcgtagaggcgggcttcaaaacgcttgtcaatgtaggtactgggctcatcaagaatcacgacctgtgggtcggagatgatggcacgtcccagcaaggcgcgttgcaactgtccgccgctcaaggcacctatggcgcgttgttccatgccttccagtcccatgcgggctatcacatggcgggccttttcccggtgtcgggtattgaagcgcgaagcaagtggcttttggctgctgaggcctgaaaggatgacttcttctactgtaatgggaaacttccggtcgatgctgctgtactggggcagataccccatggataatcgagtgttgaggggtaggcattgagaaccggctacttcgggtgacggggaatcggtatgataaagtatctctccggcagtgggcttcagcagtcccaggatgcacttgataagtgtggtctttcctccaccgttggggccgatgatacccagaaaatcacgttcgtagatagtcaggtttacatcgtgcaacacagtccggttatcgtatccggcactgaggttctttatttctataataggagatgcgagcatgtttttttctttattctccttctcctttaggggaacgaggggtgagcagtgcttgggccgtattcatcatctcctcctcccagtcgtatgagaggggattgatagccactacccgggttccggtctgctgggcgataaggtcggcattgcggcggtcgaattccggctgtacaaagatgatgcgtaccttctccttcttgcaggagtttatcaggctcttcagatgggcgggggagggctcctttccacctgcctcgataggaatctggttcaggttgtagtcgcgggcaaagtaggaaagtgccggatgataaatcatgaaggcacggtcggcattcgggctggaaagcatctggcagatgaggctgtctgtatgctctatctgccggatgagtacgttgtaacgttccatgtagacgctttcattggctttgtctatggcgcagagtgcattcagaatgtttccggcaatgatttgggcgttgatggtggaattccagatgtggggttccacaccaccggcgtgcgtatggccttcgtgtacatgcccgtctttatgatgatgtgcatgggtatcgtccagaatgagttccacattctcggacatatcgaagaattgcaggtggggagcattgtccgtcagtttttccgtccatgtctgctcgaaaccgatgtagccgatgcggaaataggccttgctttgggcaaggtcgacaagctgctggggcgtggggtcgtaggtttccggacttgaacctttgggcaccatgctgacgacggtgaattcatcgccggcaatggcttcggtgaaataccgcagcggctcgatggtgacggtaatcacgggtttatcgtcattcttcttgttctgttggcctccttgcttgcacgagaagagcaaggtggctatgaggagtaaaaaacaaaactttttcatttacaatttactatttacaatttacaatttggctgcgctgtggcagggggcatcaactattcattatcaactattccttatccatttatcacttcctctttccttcccctcagtatctcccgtttccctccggggggacctgggagacgctctaccttgaatcctacggcttgcagcatgcggcgtactactcctttggcgcagtaggtggtcagcatgccatcggtgctcatggcggcatggatattccggaagactttttcctcccacattcccggttgcttttcgggtgcaaaggcatcgaagtagacaacatcgaacggagatttattaatcattaacaaactgtcaatgcttattgtttcgacatctgcccgcacttttctcagtgtgaaataaggagttatggcaacttcttcttcccacgcagcccgatgcagttcctcgaacagaggattgtcgctatattttagcgcatccacctccggccatgcaagcggatagagttcgataccggtatagtgcacaggtctcttttccttttcggcagtttccagtgtaagcagggcattcagcccggtgccgaaaccgatttcaaggatatgcgggcgggcagtagcggatgctttcagtcccatgtcgatgaagatgtgctgtgactctgtacgtgccccctttaccgaatgataatgttcattcagttccggtacaaacagtgtcgcacttccgtcttccgtcttctctatgattcgttgcatcacttctgcttttgttgaatgtttttatttagtttaattctctgtgattcagcgtgttgttgcgcctatatatccagcgtgctgcatctatacatccagcacgttgcatctatacatccaacgcgttgtatctatacatctattgctcaaactcactacatgtcaataattcatcatcgaaatggctccttgcagtgcccacagcatagctatgtagcgcaccagtttccctgcaaacatggacgtggtggtcagcatcagattactgcgcatgaagcccagtgcaatggctatggcctctcccacaaaaggcagaaaggcgaagaaagccatcagtgcccctttcccttggaggaaatgctgcatccgttctatcttttccctttttaccttgaaatatttctcaatccagtctatacgtcccagacgtcccatgtagtagcacgtcatgcctcccagcgtatttcccaaggtggcggagagtacgcacagtgccgggctcagaccgaccttgaccagtgctaccatcactatctcggaactgaacggaatgatgcttcctgccaatagggcagagatgaacagaccgacatatccccagtcaattagcagctgtacgagtgtatctacaaaagcgtccatatgttgaatcctaatagaatgaataatccgataaatgcacaaatgaagaatatattggaactgcggctatttgtcagtacaaacaagtgtcccgccaggatgctgacaccgatgagcaggaaggacatcaggtggacactcaataccggttgcagtccgatatagacaaagatgcagaaattcagcaggatgaggaagtgcagatagctccgggtgcgtatcttgtcttcatagccggcaatgagacagtgtgccgcgctgacgatgaacagaacaaggagatacccgagggtggcgagttcccacggctgatagtcgaaccgggtgggagcgaaggtcaccagctcgcggaagggctggcagaagagttccatttgcccgtagtagagggcgtgtcccagcaacagccagtagggtacgctccatcctaccaaggaagcgaagaaacttttgggttggagagactggaagttgtaggcacctatccagaagatggggacaaacagcatgagctgcggaaaaagcaggctgcccagtccgatgaagacaaaggcgtggaagagactgcctgtgggccgtgcctgctggtagctcttgaagaggaaaaacagtgccaccaggaaggaggcagctgccaagtctcccgcatacagcatgtgtaggctggggcagacggatatcagcaggaagtagacagaagtctgtaccgatgcccgcatccggatgatggcgaacgtattgttgagctgtattaggaagtacccgatgacggcatacagaataaagctgaagagacggtttgcccaggtggggatgcagaagtcgcagaatgtttcccaaagggaatatccgctttgctgtgtctccgtctcgggcaacagaacagcggtcagtatccagcaggatactgaaatcaggatagcggtgggtagtgtgaaccgccctgccgttatccggttctggaatctcttcgttctcatttataagtcaaatccgatgtcgcgacggaaatatttcttctcgaagtttatcatgtcggccacgcggtagctcttctgcaaggcttcttcctttgtttcaccataggagcagacggcgatgacacggccaccggcagttacggtctgtccgtctttggtggctgttccggcatggaagaggatgctgtctgtttcggcagccttctcgaatccggtcatcaccttgcccttttcgtaggcttccggatatcctccgctcaccagcatgacgcaagcggctgtgcgtgggtcgaattccagtgtacgctggtcgaggtcgccctgggcaacgccttcgagcaggtctaccaggtcgctcttgatgcgtagcatcacactttcggtttcggggtcgcccatgcggacgttgtattcaatcaccatcggttcgcccttcacgttgataagtcccaggaagatgaagccttggtagccgatttcttcttcctgcagaccgtttacggtaggttcgatgatgcgggtgcgtactttttccataaatgtttcgtcggcaaaaggtacgggagtaacgctgcccataccgccggtgttgaggcctttgtcgccttcgccgatacgcttgtaatctttggctacgggcaataccttatagtggcggccgtctgtcatcacgaatacggaacattcgatgccgctgaggaactcttcaatgactaccgtggcgctggcatcgccgaacatgccgtccagcatttccttcagctctttctgagcttcttccagtgtggggagaatcagcacgcccttgcctgcacacagtccgtcggccttcagtacgtaaggcgcttcgagggaagcgaggaagtcgagtccctcctgcaagttgtcggcggtgatgctcttgtagcgggcagtggggatgttgtggcgcatcatgaagcctttggcaaattccttgctaccttccagtgtggcacctttggcggtggggccgatgatgtcgatatggcaggtggcagggtcttccttgaagctgtcgaagatgccttgtaccaacgggtcttcgggacccacaacaatcatgtcgatttctttctcaagggcaaaggccttgagtgcgggaaagtctgtcgccttcaggttcacattctcgcctgcttcgcttgtacctgcattgccgggagcaatatatagtttctctactttcgggctttgggcaatcttccatgccagagcgtgttcacggccaccggagcctaataataatactttcatgggttcatttacaatttacaatgtacaatttacaatttgtctgtgctgtggggcatcaggtaagttgtacagattgttatacttaatgatttattctctcttttattctcttctttcttctaccatctactccctatttgcacgcccgcactgcatagcaaattgtacattgtatatggtacattgtacattaaagatattcttcaaaatatcttgttatcttctcgtgcagatgcacacggtcgcgtcccaggacgttgtgcttgtgcgtgggatagataaacaaatcgggataggtacgggcatccacgcacgccttcatgaatgaaagggtgtgctgcggcacgcaggtgtcgtcgtggtcgtcgtgtatgatgagcagatgtcctttcaagttaccggcaaggtttttcagatttgtctgcttatagccttccgggttcgcttgcggagtgtccatatagcgctcaccgtacattatctcgtagtatccccagtcgataaccggtccgccggcaacgcctaccttgaaaatttcgggatagcgcagcatcagcgccgtagtcatgtgtcctccgaagctccagccgtgcacgccgatacgctctccgtccacataaggctggcttttcaggaattctacgcccttcacctggtctttgccctcttcgatgcccagctggcggaaggtggcgttttcaaactccagtccacggttgctgctgccacggttgtcgaggctgaacatgatgtagcctttgtttgccatgtagatgtcccagccgcgggcatcgttcatccagccgttcgttatcatctgggcgtgcgggccgccgtatacgtagacgatggcgggatacttctttgccgggtcgaagtcggcaggctttatcaggcggtagtacaagtctgtcttgccgtcggcggctttgatggtgcctacttctatgctgggcatttcaaagccttcgtaggggttcttggctgtcagcagtgtgtgttcccgttgttttttcgggttggtggacatcagttttatgatacgggggcaagtgggcgaagaggcattgtcgatgaggtaagttcccatgaaaccggagatttgtgccgagtgcatgccggttgggtctcctatcaagctgcgtttgccattcttcaggttgacagcgtaaaggttgctctgcaaaggagagatttccgtactcttgatgatgagctctttcgtgttccggttaaaacctacgatgtcttgtacaagccaagggccggaggtgagttgcttcagcagttccccttccgtattgtataggtataggtggttgaaaccgtcacgctggctttgatagatgaacttgtggctgtcccatggcaggaatagaatgggagattgcggctccacatatttgggatgtctctcttcgatgagcacttgttgcagctctccgctttcggcatcgtaccggcacagtttggagtgattctggtctcggtttagctctatcagatagaggcttttgccatccggtgcccaggtgatgttggtgaagtagcggtctttggggtcgcccatgtccaggtagatggtcttttgagtagccggattgtagatacctacctttacctgatggctgagcatgccggccatggggtaacgtattttatccaccagcgctattcttgccgtgatgtcaaccaatggatagggggtaaccatgctttcgttcattcgatagaaagccagcaggtccccggcaggattccagaaagtgccttttgaaatgccgaattcattgcggtgcacactttgaccgcagacgatgccttccggttcgttggtgactttcagggtttgcccgtcaccggtcatcacatagagattattgccgatagtataagccaaatggcggcttacttcgttccaatcctcattttcggcttgggcggggcaaggctggctccagatgacttttttcttcttccagtcgacgagggcacggtacttgccggtgttcagcagtaggagtgggtctatttggacttgaatacccagattgacgcctcggggtacgttgacagcctttgcagcatgaaagtgacgcagttttccaagtcctttttcttccagcagcgcgttggcttcttccaatgtgatggcagtgaatttctctccgggcttggcacctaatcctttgacagcccatgtaccttctatattgtcgatgccaagttccagacaagcggcatcgccccaccactggtaccacttgttttcggcagtatggtaggtttcacctccgggaataaggtcttccagggtcggctttttcagttcttgtgccatgacgtttgttgtaaacagagcaggcactgccatcagcagtgcaagaatgctcttacttattttctttgcattcattctccttgtcattgttcgtgttattcttcttccttctttcccgcctctcttctttttctttccgggtaagattcacctgaccttgttctgcgttctccaccgaattcgcgtctttccctcggtctgaactcccgtttttccccgtctttgaactctcttctttcacgcggacggaattcgcgcttttcgctgtccttgaattctcttggtctgcgttcaccgttgaattcgcgtctttcgccaccgaattcacgtctctctccgctgaatcggggacggaattcgcgtctttctccgggtttgaactctttcctttctcctgaagccggacgaaattctttgcgctccttgctcaactcctcgccttcggcacgaaattccttgtactttccatcgaagatttcgtactggcggaattcgcattccagcgcaccattgaataaaggtatcttggaggtggcttttagcccgatttggtcgaagcactcttcccggtaagaaagaatccatgcggtgttgcccgtaaaggcatgtttcagacgctcgccaatcatggagtaaaggcccagcaggtcgttggtagagatacgctcaccgtagggaggattggtgatgatgatggatttctccgcaggttgctcgaattgctggaaaggttgcagcttcaataccacgtccttgcttacgccggcagcctttatattgtgtgtggcaatttcgtttgccttcgggctgttgtcgtaaccgtatatcttatgcgtaaattcacgttcctggctgtcgtcattgtatatcgtgtcgaacagctcctggtcaaaatccacccacttctcgaaagcgaactccttgcggaatacgcccggagcgatgttgcgtgcaatcagcgccgcttcgatgggaatggttcccgaaccacacatcgggtctatcaggtcgcattcgccacgccagccggtcatcaatatcatgccggcggccagcacctcattcagcggggcctctactgcttcctggcgataaccgcggcggtgcagcgattcgccgctggagtcgagagacagcgtacatttggtttcggcaatgtgtatgttcagcagcacgtccggtttgttgacacgcacgccgggacgttcgccggtcttctcgcggaaatagtccacgatggcatccttcaccttgtaggaaacgaacttggaatgacggaactcttcactgaatacaaccgcgtccacggcaaaggtcttgtccgtatccagatagtcttcccatcggatggctttaatctgttcgtaaacctcgtcggcatctttggctgtgaagtgtttgatgggtttcagtatccggatggctgtacgcaggcagaagtttgccttgtacatcatttccttatcaccactgaaagataccatgcggcggcctatttctatttcgttggcgcccagtgcagtcagctcttgtgccagtacctcttccagtccttggaaggttttggcaatcatttcaaaagattgttcgctcatctatgcatttactttatgtgaatcggcaatctgggtagttgtcactcgtttctctcattagtggctgataaccatttaactacttgaactgctgatttgagttatttacgattttaattgtttattggttgtttgtgacttacttcttggcctttgtctgtacaatccttgctcctgcgggaacatcttctgtcacccagatattgccgcctacggtggctccttgtccgatggtgatgcgtcccaatatggtggcgttggaatagactatcacattgtcttccagaatgggatggcggggaatacccttgatgggcttgccgtcttcgtctagcgggaagctcttggcaccgagggtcacaccctggtacagcttcacgttgttgccgatgatgcaggtctcgccgattaccacacccgtaccgtggtcgatggtaaaataaccacctatttccgctcctggatggatatcgattcccgtttcactgtgcgccatctcggtgatgatgcggggaatgaggggaacacccaacttgagcaactcgtgtgcgatgcggtagttgctgatggcgcggatggccggatagcagctgatgacttcgccgaacgactgtgcggcggggtcaccgttgtaggcggcttccacatctgtggcgagtgtacgtctcattgccggcaggttgctgatgaacttggcagccaataaggcggcttcttcccgttggagctcggtacaacagttgcattcgccgtcgcctgcaaagcagaggccggcaaggatttgctcggtcagcaggtcgaacaagcgttcgacattgacaccgatatggtaagtcaccgtacggctgttgaccgtagaatttccgaaatatccggggaagatgatggctcgcgccagttcgatgatgtcgcgcagcacttttgccgaaggcagcgggttgccgtccgtatgctggtgaaacagtcctttgtatgattcgctttccgatagctcatcgactgcttgtgtcaaaatgtgggtaaagttgagtggactcattatgatatccttaagtttaaaagtggcaacaaagataggaaatactcgtcaaatatcctacatatccctcatttatagtacgtatttaccatatttgtggtattttctacgaaccaattttgcgctacttttgtcttgtaagaaataacatacctcgttccactccggattgttagtcttttcccttaggggaatgaggaatttaaaaacagttggattatgaagaagatagcagaacgccttaccgacctggtaggcaacactcccttgctggagttgaataattataacaagaataagggtctgaaagcccgtgttattgccaaattggaatattttaaccctgccggcagtgtgaaggaccgcgtggcgcttgccatgatagaagatgccgaggcaaaagggctgttgaagcctggtgccaccatcatcgaacctaccagtgggaatacgggcgtagggctggcttttgtggccgccgccaaaggttacaagctgatactgacgatgcccgacacgatgagtttggaacgccgcaacctcttgaaagcccttggtgcggaactggtactgacttcgggtgccgacggtatgaaaggcgcaatagcccgtgccgaagaactgaaagccgccaaccccggctcgctgattctacagcaatttgacaatcctgccaatccggcaatgcacgagcgtactaccggacaagaaatctggcgtgatacagacggccgggtggatattttcgtggccggtgtagggacgggaggcacagtgagtggtgtgggtgcagccttgaaagccaataacccgaaggtaaagattgtggctgtggagcccgaagattctcccgtactttccggtgggaagcccggtccccataaaatacaaggtatcggtgccggatttgtgccgaagaactataacagtgccgtaatagacgaagttctgcaggtatccaatgatgacgccatacgtacgggccgcgaactggcgaagtatgagggattgttggtcggcatctcttcgggagctgccgttgctgcagctacccgcttggcacggttgcccgagaatgaaggaaagacgattgtagcgctgctgcccgatacgggagaacggtatctttcgacgctgttgtatgcatttgaggaatatccgttgtaaaagtaaatatttctgccggttatccgctccatcaatgtggagcaggtgaccggcagatggtatttatagttcgcttggtcttaacccgaatgaccggcagcttattttctctactttcacttcccatatcttgacattgcgtacggcgggttcggcatatttgcattcattttccgtatattgcttcatcagcatgtcgagtacgcgtcgcttctcttccatgtcttccacgaagtgtactttcccacgacagataacactgcgcgacttcatgctgtagctgcatgccacttgccggtgcatataaaccagctcgtgtccttcgcagaaggtgatgcaaacttgcgggtgctttgttaccatctccactttactgccttccgggccggaatgcaagtatattaccccgtcttgataggcaaagttcatgggaaccgcatatgggtttccttcaaggtctgtgatgcccactatgcagtatgggcatttacggataatttcctcaatctgtgtagggtctgtaatagtaattgtcttcatgtgcaaagcctcacccccggcccctctccgaaagagaggggagtggggaagtggggatatttaatattgtagggttattctttatttcacttcactcaagtttcgcaagttttcaattcattgctctcctctcccctctctttcggagaggggtcgggggtgaggttacaccagtgcaaagtccagctgcttcttttccaagttagcgcgtgccaccttaatggtaatggcatctcccagactataaattttatttttgcggcgtccgcgcaggcagtagttcttttcatcgaattcgtaatagtcatcgtcgaggtcgcggatgggaatcatgccttcgcacttgttctcattcagctccacgtagagtccccattccgttacgccggagatgacgccgtcgaaggtctgtcccaggcgttcggtcatgaattctacttgcttgtacttgatggaggcgcgttccgcgttggaggctatctgctccatgctgctgctgtgttcgcagagggcttcgtatttctgttcggacacggtgcggcctccctggtccaagtacttggtgagcagacggtgtaccatcatatccggatagcggcggatgggcgaggtgaaatgggtatagtaatcgaaagccaaaccatagtgccccacgttatgcacggagtagcgtgccttctgcatggcgcggatggagacggtttcaatcaagttctcctccttcttgccctggatgtcgtccagcaggtggttgatggacttggagatgtcggtctttgtaccgctggtacgcagcttgtagccgaaacgggcgatgaactgtgccaggttgtccagcttctccgggtcggggaggtcgtgaatacggtatggcaacactttggctttcttgcctttgggcacgcggcctatcttttcggctacggtgcggttggcgagcagcatgaactcctctatcagcttgttggcatctttcgactccttgaagtagacgctgacgggtttgcccttctcgtcaatttcgaacttcacttcgtagcggtcgaagttgatggctcctgccttaaagcggttctcacgcagtattttggcaagcttatccagttggagcatctcttcctggaagtctcctttgccagtttctataatctcctgggcttcttcgtaggtgaagcggcggtcgctcttgatgacggtatgtaccacgcgtgagttcttcacttcgcctttttccgtcatttcaaagatgacggagtaggcaagcttctcttcgtcggggcggagtgaacagatgaaattacacaaccgttcggggagcattgggatggtgcggtctacgaggtagacggatgtggcacgcttctcggcttccttgtctatgatgccgccctctttcacgtagtgggtcacgtcggcaatgtgtacgcctacttcccaaagtccccctttcagtttgcggatggagagggcgtcgtcgaagtccttggcatccttggggtcgatggtgaaggtggtcacaccccggaagtcctcacgtcgggctatttcctcggcggagatttcggcgggtatcttgtcggcagctttctctacggcagcggggtagacatagggcaggccgaattccgccaggatggcgtgcatctcggtggtattgtctcctgcgcgccccaggatgtcgattacctggccgatggggttcttggctttgtcgggccattccaccacctttacgatggctttgtcgcccgtcttgccgcctttcaacttttctttggggatgaagatgtcgttggcaagcgtacggttttccgttacaaggaaagcgtatgacttggcaacttccagggtacccacgaaggtgtcgttggcacgttccagtatctcgatgacttctccttcggcttcgcgtccgcgacgcttggcatagaaggcgatacgcactttatcattgttcatggcgtgtgccgagttgcgttcggccacgaatatcggttcgcctccaccttccggtataaaggaattcttgccgttgctcttgcgctggaaggttccggtcatttccacgccgtggttgttcagcttgtatttgtgcttgtccacttctgtgatgtagtcgtccatcgacagttcggacaagatgtccatgcacagcatcttcagcggatgtgtggtgaggtggagttgttcaaagatgtatttcagggataatacttcgtcttgctttgtgtggaagaattccagcagtactttgacgagctctttcttcttcatgcgtttgccggctttcttttctttctttttggccataatgttatgatgtattttatgtataaatagagattctgtgtcaatctgtgtaatctgtggtgattacctcttgcaaagtaaacaaataaatatgttccttcgttcactcagacttcaaaatattatcattctattgaaaataatgaaggaacgacagattgtaatggatttatgtactatatttgcacacaaagtgaagataggctgtaccttagacgaaaagcagatggaaatgcaaactctgaacaaaaaagcagatgccacacgggaaaaagacatttaccgggtgacggttgtggggagtgtggtaaactttctcttgcttgtcttcaaattctttgcaggtattgtaggtcacagtgccgccatgctggcggatgcggtacattctttgtcggatttcattacagatattattgtcattgtttttgtgcgcatttcggcaaagcccgaagatgaaggacacgattacggtcatggcaagtacgagacgctggcaactgccattatcggtatttttctgttgtttgtgggattcggcattttctggaacggggcttcctccatttaccgcttcctgcaaggcggctctctgcaggaacccggtatactggcactggtggctgcattggtatccatcgttttcaaggaagtgctttatcaatataccgtattcaagggcaggaagttgaattcgcaggcggttgttgccaatgcctggcatcaccggagtgacgcgttttcgtccataggcacggcagcgggtataggtggcgccattcttttgggtgaccattggcgggtgctggacccggtggcagcggttattgtcagcttcttcattatgaaggtggctgtgcagttgttgataccgtgtgtggacgaactgttggagaaatcattgcctgccgaggtggaggatgagatactgaagacgattctctcttttcccggtatcagctcgccgcatcaccttcgtacgcgccgcatcggcagttattgtgccatcgaggtgcatgtgcgtatggatggtagcatctcgctggaggaagctcacgagacggcaacggcggtggagaacaagctgaaaaggcagttcggcaaaggaacactggtcagcatccatgtggagccggtgaagaagagtaacgaggcgacagagtaacacaaggagcgtcaaggtgacggaccggatgaaaagtaattagtaatttgtaacagaagaagtggaatcgattttaattacaggagcaagcggatttatcggaagtttcatcgtggaggaggcgttgaagcgcaagttcggtgtgtgggcgggtgtacgttcgtccagcagccgcgagtatctgcgtgaccgcaagatacatttcctcgaactggactttgcgcaccccaatgaactgagggcacaactctcgggacataaagggacctacaataagtttgattatattgtccattgtgccggtgtgacgaagtgtgtggacaagaacgaattcgatttggtgaattatctgcagaccaaatacttcatcgatacgctgagggagctgaacatgattcccaagcagtttatcttcatcagtacgctgagtgtgttcggcccggtacgcgagaggacctacgacccgattatggagagtgaccccccttcacccaataccgcctacggactcagtaaactgaaaacagaactttatttgcagagtattccgggtttcccctacgtcatctaccggccgacgggtgtatacgggccgcgtgagaaggattattacctcatggcgaagtccatccggcagcatacggacttttctgtaggcttctgccgccaggacttgacgtttgtatatgtaaaggacatcgtgcaggctgtcttcctcgggatagagaagcaggtgtcccgccgcgcctatttcctggctgacgggaaggtgtatagcagccgtgctttttccgatttgataaggaaagaattgggcaatccgtttgttattcgcctgagatgtccgttaattgtattgaaagtcgtatctttgctcgccgaattctgggcgaagcggcagaacaagaccagcacgctcaattcggacaagtatagaataatgaaacaacgcaactggcagtgtgacatcacaccggccgtcgaggaactgggcttcagtcctgagtacgacctggaacggggtgtaaaggaaaccattgcctggtataaggataagggatggctttagatttatttaaaagggtagaaacccgtaaggggctttttgcggtagagaagattacgctgatatacaatttgctgacttccattctcattctgtttctttttcaggaaatggatcatccggtgcagatgcttgcagaccgtgttgtcattgcgggtatgacgttcctgctgatgtatctttaccggctggcaccctgcaagttctctgcctttgtgcgcatagccatccaaatgtcactgctttcctattggtatcccgacacctttgagttcaaccggatattccccaatctcgaccacgtgttcgcgtcggtggagcagtggatgtttggcggacagcctgctgtatggttctgtgaaaggtttccgcagatgtgggtgagcgagccgttcaatatgggatacttcttctattatccgatgattctgctggtggtggtgtggtatttcctttatcgttttgaccttttcgagaaggtttcgttcgtcatcgtcaccgctttcttcatctattaccttatttatatcttcgtccccgttgccgggccgcagttctacttccccgccattggaagcgaccatgtggcgcaaggtatcttcccgtccatcggtgactatttccatcaccatcaggaacttcttcccggtccgggctatgagcacggcttcttctacaacctggtggagagttcccagcaggtgggtgagcgccccacggctgcttttcccagttcgcacgtcggaatgtctacggtactgatgattatggcatggcgtggcagcaagcgtctgtttgcctgcttgtttcctttctatctgctgttgtgcggggctacggtctatatccaggcacattacctgatagactctatcgtgggtttcgtatcggctttcggcatttatatcctggccacgtggatgttcaagcgatggtttgcgcagccgatgttacgctagtcgggcacggtgattatctttccactgtctgtgggcaataccaatgtacgcggataaacttctgccggaagtgaatgctggaagtttacgatgagctgtttgagcagttttttctttttcataaagacatatttatgggattctttctttcttgggaagacgaatatagggacttgtttctttctgccaaagaaacaatgttttttttcttgcctccttgttggcaaggttttgccttcccattggcaaggctttgccaccgcgttggcaaaactttgccataggcatggcaaaagtttgccaagggcaaggcaagtggttggcaaaatttcttgctgacagacagtgagttatgcggatggcaacaaagcgtgtcatctgcgtctgaatagcccccctctcagaagctattcaagaaggggcgtgaggatgattgctcaagtatcggactcgatggtaaaaatcgtatgcggttttctcctatggcagcaacggttctatctcttcgaagatgcggtacagttcctccttcgtctctgcccgcagcatggctatccgggtgtcgcggaaattgggaatccctttgaagagcgggcttgctgccaggtggcggcgcacgtgcagtatgccccgtcgttcatccagcaggttgacgctgtcttccacttcctggcggagtacgttcagccgccattcggaactcagcggagggagttcttcgcccgtctccaaataatgcttcacttccttaaagaaccacgggcggccgaagctggcacggcctatcatgatggcgtccacaccgtagaggtcgaagcattctttggcccgttggggagtggtgatatcaccgttgccgatgatgggaatgtgcatgcgtgggttctttttcacctcgccgataagtgtccagtccgcctcgccggtatacatctgggcgcgggtacggccgtggatggtgagggcggcaatgccgcagtcctgcaactgctcggcaaggtctacgatgattttactgttggcatcccagcccaggcgggtcttcacggtgacgggaatcttcacggcatctaccacggcacgagtgatttccagcatcagcggaatgttctgtagcataccggcaccggcacccttgccggcaacgcgcttcacggggcagccgaagttgatgtccagcgtgtccggatgtgcctgctccacaatgcgggcggcttctaccatggtggcggtgtcccgtccgtatatctgtatggctacgggccgctcttcatcgctgatgttcagtttctgctgggtcttgcctacggagcgtatcaaggcatcggcagaaacgaactcggtatataccatgtctgctccgaagtgcttgcacatcaggcggaaagcagggtcggtgacgtcctccatcggggcgaggaatacggggcgtgggcccaggtctatatctttaatcttcataatctaagcggatttgtccgcaaaagtacagaaaaaagcctacctttgcatactctaattcaaaaagaaatgatgaaacactcaatcagtgacttcgaaatcatggcaccggtaggctcgcgcgaatctctcgcagcagccatacaagcaggtgccgactccatctatttcggtatcgagaacctgaacatgcgtgcccgttcggcaaataccttcactatcgacgatttgcgggaaatagcccggacgtgcgacgaacatggcatgaagagctacctcaccgtcaataccattatatacgaccatgacattccgctgatgcgtaccattgtagatgcggcaaaggcggcaggcatctcggcagtcattgccgctgatgtggcagtgatgagttatgcccggcagatagggcaggaggtacacctcagcacacagctcaacatcagcaacgtggaagccctgcgcttctatgcgcagtttgccgatgtggtggtgctggcgcgtgagttgaatctggagcaagtggcagaaatctaccgccatatccgtgaggagaatatctgtggacccagcggagagcagatacgtatagagatgttctgccacggtgccctttgcatggcagtcagcggaaagtgttatctctcattgcatgagatgaaccactctgccaaccgtggtgcttgcatgcaggtatgccgccgtagttatacggtgcgcgacaaggagacggatgtggaattggaggtggacaaccaatacatcatgtcccccaaagacttaaaaactatccacttcatgaacaagatgctggatgcaggtgttcgtgttttcaaaatagaaggacgtgcccgcggacccgagtacgtgcgcacggtagtggagtgttacaaagaagccatccgttcctatctggacgatacattcaccgatgagaaaattgcccggtgggacgaacgtttgaagacggtcttcaatcgtggtttctgggacggctactacctgggacaacgcttgggcgaatggaccaagaactacggctctgccgctacggaacgtaaaatctatgtgggtaagggcatccgctacttctcaaacatcggtgtggcagagttcctggtagaagcagccgaagtgagcgtaggcgacaagttgctgattacgggtcccacaacgggtgccgaattcgtcactttggacgaggcacgcgtcgatttgaaacccgtgcagactgtaaagaaaggccagcatttctcgatgaaatcggtgaaaatacgtcccagtgacaaactctacaagctggtcagcgtagaggaactgaagaagttcaaaggcttggatgtggagaaacaacgtggctaagtatcaaatagtaaatagtccaatagtaaatatgaattatatctatgaacttcccatgaaggtgcgcgactatgaatgcgacctgcaaggcatcgtcaataatgccaattatcagcattatctggagcatacgcgccatgagtttctgttgagtgccggcgtcagctttgccggactgcacgagcagggggtagacccggtagtggcacgtatcaatatggctttcaagactcccctgaggagtggtgacgagtttgtctccaaactctacatgaagaaggagggtatcaagtacgtcttttaccaagatatcttccgtgcttccgacggcaaagtctgtctcaaaggcatagttgaaaccgtatgtgtggtgaacggacggttaagcgatagcgaactgttcgaccgtctctttgccccttatctcaatccgtgtgaatctgtgtaatctgtggtggaatgaacagtgacgaacggatttgcagcatagctctcacactttgccccggtataggacatatcggggcaaagcgtttaatagagggtatgggcagtgctgccgaagtattcagtcggcggaaggagctccccgaaatcatgcccggtgtgaatccgggggtagtgacggctcttgattgtcccgctgcctttctgcgtgccgagcaggagatggagtttgtagagaagaatcgtctttcctgcctgacgttgaaggatgaggcttacccttcccgcttgcgcgaatgtgaggatgcgccgattgtacttttctttaaaggaaacaccgatttcaaccgcctgcatgtcatcgatatggtaggtacacgccgtgccaccgattacggcaagcaattctgtgccgacttcctgcgcgatttggccgttctttgtcccgatgtgctggtagtaagcggactggcttacgggatagatatccatgcccatcgggccgctttggcaaatcatctccctaccgttgctgtccttgctcacggactggaccgcatctatccgtatgtccaccggaaaacagccatcgacatgctggcacaaggcggactgctgaccgaattccttaccgggacgaatccggacaagcataatttcgtcagccgcaaccgtattgtggcgggtatgagtgatgctaccattgtggtggagtctgccgcaaagggaggttcccttatcactgcagagttggcggagggataccatcgtgactgttttgccgttccgggacgtgttacggacgaatcttccatcggttgcaaccggttgatacgcgacaacaaggccgcccttatccagagtgcggaagagtttgtgcagattatgggctgggccgtagcggagcagcctgcccggacagaaggtatccagcgtaatctcttcccggaactgacggaagaggaggagctcgttgtgcgtattcttatgcggcagggagacctccatatcaatgcgatggtggtggaagcggacatacccgtcaaccggatgagtgccttgctttttgaattggagatgaagggagtggtcaaggcaatggtgggtggtgtctatcacttgctgacttgagcgcggcaggtctcttgccttatatggacggtttcccgtatttcatgatgaacttttccgggtggtctgtcgctatgatgtctacccccaggtcgactgccttctggttctcttccgtcttgtcgtccagccccaggacaagtgccagtacctgcaggttgtgctcacggcatttctttacgaattgcggggtaagggagtcaatccagacgacagcgatgtcgggatgcagttcctttacgacatgctctatgtccttttcacttttgatgtaggcttgcagggttcttacctcgggtgccatctttctgaagcatttggcatgatactccttgctgaaggtgaagttgcagttttccagcatgccttcgtcctttatcaagttcagtaattggtgcagaccgccgttgcggtagtcgatggtgattcttaaaccgtgctctttggccttgcgtagcaggtcggtaaggcgtagtacccgttgtccggcaaatcggggcgcaaaccaagagccggcatccagtgtgtcgatgtcggtggacagccattgggagatggcgccggtaccgttggtggtacggtcgagggtggaatcgtgcagtacgtagaagacactgtccttactgatgcagacatcgcattctatattgcctacaccgtatttgatgcacgaatctacggatgccattgtgttttcgggagcgatggtggccgcaccacggtgtgcgctggttaggggtatcttggtggtggcaggccgttgggaacatcctgcggtaagtaggattatggaaagcaatgtgagtaccggttttttcataatgggctcaagtagtgatgttttcttctttaacagttataaaagccatcgaagatagctattttttgtcattcggagaaacgtatgggcataaaaaaaggagtaccgctgtactccaacctttgttaaccttaaatctaatactatgaaaaaaatcacattacaaatgtaaggttcccgttgttatcttccaaatttcagaatgttcctgctacttcttttgtatttctttcactgaattttactgttttcgcacacggattgactttttgagagagaagaatctattcacagcgtcccggataaggcagaagttgcaaatctgtttcaatcgtttcacagaacctttcagcctttgaaaagagtgatggaaagtgatttttattcggtaattatcttctacttttgtttgtatacaacgcgaaattatgggaaaacgcatttttatatatgtcttttggctactccttttttgcatgatgtcggggcaggtaatagggcagaataagtcggtagaatcccatagccatacttgtaaaacggtgctggcgttaaaaaataatttgctttacgacctggccttggctccgaacatagaagtggagctgccattgggaaagaggtggtctttgaatgttgagtacaaatgcccttggtggtctgacagcggatgtaatttctgctatcagctcctttcgggagggacagaggcgcgttactggttgggaaaccgccatacgcgcggaagattgtccggacacttcctgggagcatatgccgaaggaggtacctatgattttcagttgaaaaaggagaagggataccgggggaagtattacgcagctgcaggaataacttatggatacgtgcgtccactggctcggcatctggcgattgaattcagtgtgggcattggatacttggatacggagtacaggaaatatacttcttatggaaatgacttggtttgggtcagcagtggaaagtatcactttatcgggccgacaaaagcaaaaatttctttggtgtggcttctaacgtcggggagatgagtggtatgaaagatgcacggcatatgattctctggctgttcttcgggctgttgccaatgctgggaagctgtgacttccgcgatatgctggatgattatcccgttagcggagtacagattaaactggattggaaaggggtgacggataagctgccgcagaccatgcggattatcttctatccgaaagatactcaagggagaaaggttgaaagttatctgcctgccggagggggtgaggtgaaggtaccgccggggaagtatgcggtggtggcctataacttcaatacggagagtatacagatacggggcgacgagagttatgagacgattgaggcttttacgggacactgtacggggctggatgtacacgaagatatggtttggtcgcccgaccctttgtatgtggtggctttggacgaggtggaaataaggcagagtgatgtggcgcttccgttggactggaagccggaagcggtagtggaccattattcctttgatataaaggtggaaggatgggatagaatatcgagcatcatctgccatgtggacggcttgaacggaagttactttataggcaaccgtgcttgccatttgagcgaggtacctatatgtgtggatacaaagcgtgaaaacgggcttttatgggggtatttctccagttttgtattactgaaagataccaagacccgtgcggatagtcctatgttgctgacactgaggattgtgaaacgagataaaacggttcaagaggtgaaggtggatatcacggaagtgattgaaacagctcctccctcgggaggaggcgaagaagaacctgatgtgggcattcctgggtcggaaatccatatcgaggttcccgtaccggaggacaaggttgtggtggatgatttggaaccgagaaccgatgaaggagatggagggattggtggcgatgtggacgattgggatgatgagacggatgtggagctaccggtgaattgatagcaaacagacaaataaatatattaactttaataacagacaattatgaagaaggttttatttttggctttggctgcagcagcagtaatgagttgctcggaaagtgaggagatagagaatgccggacaaaaggcggagattaaattgggaacagtagtgggtaacactacgagagccacagtgactgatttgccggaattgcagaaggtagggttcactgtgtatgcttataatacgggagcaacaacaatggcctccgttgcgacttttgatgcgatgaaggaattcatggcagctgttaaggtaacttatagtgctcccgactggagtttgactgggggaacatattattggccaatgacggataacttgcagttctttgcttacgggaatccgggtaccggggccttgacgtacaatcaaccggctgctggtgctatatatccttccattacttatacggtagcggatgtagctgcccaaacggacttggtagccgcgaaagcgacggatgcaaccaaggcatcaaatgccagtggggtatctttgaaattcggccatatactgacccaaataaatttcactgtcaaggcagccgacgctttgacttataaactgaaaacacttacaatatccggtgtgcacaataaaggaacttatggttttgatgattcaatatggaagtcacaggaaggaacagccacttatgcacatacgattgacgatggtgcattggaagtgaatacaacgggtgtggaagtgaatacagcctggatgttgatgccccagacgttggatacgaatgccaaaatcaatgttgtctatgacatctatgagaaagacgttcttcttgatactgtaacttccgccattgacttgaatgatacacaagcctggggtgaaggcaaaaagatacgttatacgctgacgctggccaataaggcggcaaaagtaacctttgtacctgaagttggtccatggagtacggctgatgatacgaacgtggaaaaataaaacggcactgtccgcaataaaaaactgaattacttctattttattcattccccgaaacttctttatgaaagttttcggggaatgtttcttttatgagtattatttatctatttttgtcactgcaacaaacaaacaaatctacttgccgatgcccaactcttctgcttgcagaggtaaaaaacaatgcgctcaatgtcccaaggctgtggacaatgcaataatatatgcttcccacctcagaggattccatctgccggcgcgaaagtgtgaggaaaatattataattttcctgctgaaaggagaagtgcttgtcaacagtaaggagtatgcgggaactgtgttgcatgcaggtgagttcatccttcaagctattggttccaagtacgaaatacttgccatgacggatgtggaatgcgtttgttaccggttcagtaagcctgaattcttctgtgaggaccggtataaccatattatgaaagaggttacccctccattgatattctatcctttgaccattactcccgagttgcagctctttctggaaagttccaaggcctatttgtccgaggagaagatttgccgggaaatgctttgtttcaaacggaaagaacttgctttcattcttggaaattactactccgactatgagctttccatgctgatacatcctcttgcccagtatactaattccttccactactttgtcttgcagaatcatgccaaagtcaagacggtagaggaacttgcccagttgggaggatatacagtagctactttccggcgtatattcaattctgtttttcatcaaccggtgtacgagtggatgatggaacggaggaaggaaagcgtggtttatgaacttcgttatacggatgcttctatatcagagatttgctataaatatggctttgaatcgctgcctcatttttccaatttctgcaaaaagaatttcggggcttctccccgtagcttgcgtgccggcaatttatctgaagtaaacggcatgtcataaaaaaactcctccggcggtttcccggcagaggagtctcttgtgatattaatcaaatatagtgaaagctgagtgataaatctgagcttgctcaaaaggtttatccgaagcgcatcctatattatttacagaaagaccggattagtctttcagtttcgcaatgataaagtcgcggttcaggcgagcaatgttgctgatggaaacattcttcgggcattcagcttcgcacgcacgagtgtttgtacagttaccgaaaccgagttcgtccatcttgctcaacatagccttggcacggcgcaatgcttccggtttgccttggggcaacaggttcagctggctcaccttggcagaaacgaacagcatagcagaaccgttcttacaagcagccacacaagcaccacaaccgatacagctggcagcatccatagcctcgtcagcgatgggcttcggaatcaggatagcgttggcatcctggggagcaccggtacgtacgctgacgtagccgcctgcctgcataatcttgtcgtaggccgtacggtcgaccatcaagtccttgataaccgggaaaccggcagagcgccacggttcaacagtgatggtatcgccgtcgttgaaacgacgcatataaatttggcaagtagtagcgccggttgcaggaccgtgggggtgtccgttgatgtagagcgaacacataccgcagataccttcgcggcagtcgtggtcgaatacaaccggttctttaccttcagaaatcagctgttcgttcaggatatccagcatttcgaggaatgaagtatcgcccggaatatctttcatttggtatgtttcaaaagcgccttttactttcggacccttctggcgccataccttgagcgtaaatgatatatttttatccattttctttaattctttaaatgttcaacttcccgattagctcttgtagttacgagtctgtaccttgattgcttcgtaaaccagcggctctttcagcaataccggttccttttcgtcagaaccctgatattcccagcaagccacgtagaagtagttttcatcgtcacgcttggcttcgccttcttcagtctgatattcttcacggaagtgaccaccgcagctttcgttacggttcagtgcatcgtaagcaaccagctcgcccatagtgatgaagtcgtacagacggatagccttgtcgagttctacattcataccttccttgtcgcccgggatgaacagttctttctcgaactccttgcggacttctttcagcttcttcagaccttccttcaagccttcagccgtacgtcccatgcctacatattcccacatgatgtggcccagttccttgtggatagagtctacagacttcttacccttaatattcatcatccagtcaatcttgtcctgaacagccttttctgcagctgcaaattcgggcaggtcggtagagaaacggggaactgtaatctggtcggccaggtaattctggatagtgtaaggcaatacgaagtaaccgtcggccagaccttgcatcagcgcagaagcaccgaggcggtttgcaccgtggtcggagaagttacattcaccaatagcgaacagacccttgatggaggtcatcagttcatagtcaacccagataccgcccatggtatagtggatagccggataaatcatcatcgggttttcgtatgggctgacatcagtgatttcttcatacatatcgaagaggttgccgtaacgttgtgcaacgacatctttacccagacggttgatagcttcggagaagtcaaggaatacggcaaggccggtgttgttcacgccataacccttgtcgcagcgttctttggctgcgcggctggcaacgtcacgcggaacgaggttaccgaatgctggataacggcgttccaggtagtagtcgcggtcttcctcgggaatatcttttccttgcagtgtaccttcctgcagtttcttggcatcttccagcttcttcggaacccagatacgaccatcgttacgcagagattcggacatcaaagtcagcttagactgcttgtcaccgtgaaccgggatacaagtggggtgaatctgtacgtaagcagggttggcaaaccaggcacctttacggtagcaagccattgctgcagagcagttacatgccattgcattggtagaaaggaagtaggcattgccgtaaccaccggtagcgattaccacagcgtgggcggcaaaacgttccaatttaccggtaacgaggttctttgcaatgataccgcgggcacgtccgtcaatgaggacaacgtcttccatttcgtagcgggtatacagtttcacagtgcctacgttcacctggcggctcaatgcagagtatgcacccagcaacagctgttgtccggtctgacccttggcatagaaagtacgggatacctgagcaccaccgaaagaacggttgtccagtgtaccgccgtattcgcgggcgaaaggaacaccttgtgcaacgcattggtcgataatattgttggatacttcagccagacggtaaacgttagcttcgcgggcacggtagtcgccaccctttactgtatcgtagaacagacggtatacagagtcaccgtcgttttggtaattcttagcagcattgataccaccttgtgcagcgatggagtgtgcacggcgcggagagtcttggatgcagaagttgaatactctgaaacccatttcgcccagagaggcggcagcactggcaccggcaagtccggttcctactacgatgatgtccagacgacgtttgttggcagggtttactaatttttggtgagccttataattggtccatttctcagccaccggtccttccggtattttagaatctatcttagtcataatgcaatttacaatttagtcatttacaatttgaatttagcaagcgccgcacaatgattttgcaaagaatacgacaactaccagagcgaagcagaggacaacgatagtagaatagatgttggagatacatttccaacggttaatccatactttgttgttccagcccaaagactgcatggagctccagaaaccgtgagtgaggtggaaccacaatgcgcccagccaaacgaggtaaagcactacgaataccggattgctgaaggtgttttgaatgtgatagacaccgttggctgcatatgccagcgtgagggtgtcagcatgcatgcccatgttgtgcatcaactcgggaagctgcattttagcccagaagtttaccaggtgcaggcccaaacccacgattacgatgatacccagtacgagcatgttttgagaagcccattccacagtcttgggcttttccgtaacggcatagcgttcgctaccacgtgccttacggttctgcatagtcagccagaaagcgtagatgatgtggatgatgaataaggcagccagacctaccgtagccaccaatgcgtaccagtttgctcccaggaactcacaaaccatgttgtagccattagccgagactaatgcaaccaggttcatcgccatgtgaaatgtcagaaacaggacaagggcgataccggtaacgctcatcaccactttccttcctacagatgaattacttaaccacataaatgattgaatttaagttatttaatagtttgaaaatttgttctatcaggatacttctgtaaatgtttcgcaaaaataggagaaatccagcgataaagcaagcgattaaagaaataattccgtaatccggcagaatgcgaagtttacggacaagtaaaaggtttactcgtcctcctggtctttgccttgctctttgcagataatggaaatcttttctccgtttgctgaacgttttctcagggcgcggggcgtgtctccgaaagagtctttgcagaagtgggcaaagtgggatagggaatcaaagccatagcgggcgctgatgactgaaatgcgttgtttggtgtattgcaggtcgttcagaattccttcacgtttcttgtccagaatccattcatagaccgggaccccatacatatttttaaacagacggcggaatgtggtggtggtatatccgccgaggtgggcaaactcttccacattcttcaccttgtcgtagttctgcatgacgaaatattggaagctttccgtataagtgctgatggggtagaagaatgtactgatttggtgtagcggatagtagcatgtcaatatgtataccaattcctggcatttcatttcaatgtatttgctgcacgcatagggttgctcgttgaggtagcaggcaaggcttttcaggagcccttcgagcatggaaatcgcggtaagcggggtataagtcaagggggcttccgagcgtttcagtatctccttgtagcgctcttcgcaaatcagaggaagctcggtgaaccaatagacaatatattccacttcggtcaaagccaggagttctactttggagccgatggcttgcaagatgagttggcggctttggagagtggtgcccggatattcgtcactgtttacaagtaattcacctttcagcataaatatcatgcagttctgtgtgcacttttcagcagagaaatgttgtcccttggggtagtggcggtaaaccaatactccttctgatttttggggacataccatacaatcaatctgtcggttgcagcaagtttccagtctcatgaaatgattagcgaattattataaatgtggcaacaaagatagaatttttttgtgaaaactctatctatttgtcctatctttgcgtcaaactaatataaaggacttatgaaaaaggctattttttttgtatattttatctgccttgttgtatccggtctttcggcacagaattgggatattaacactttgcaccgggttaacagttgggatggcaagtttgtccgtaactataataagataatttcacgttcggagccctatgttgctgtcggtgttccggtggcgatggcggttgccgcttggataaaacatgataagggtttgctgaaagatgcggtctacgtaggtacaagtgtagcgggggcttttgttgtgacttatggaatgaaatatctggtggaccgtgagcgtccttatgataaatatcccgacagagtgcatgcatatagccatgaaggcagcccgtcttttccttctggacatacggcgacggcttttgcccttgccacctcgctcagtgtaaagtatcctaaatggtatgtgatagctccgtctgccctgtgggcttgttccgtgggagtttcccgtatgaacgagggagtgcattatccgtcagatgtgttggcgggggctgcaatcggtgctggatgtgctgtggtcaacatctacgtcaacaagtggctgaataagtggctgttcggagaatgattttaggcgcgaattacgcggaatacgcggagttagataaactaaatccgcataatccgcgcctaagtttgtttcaagtcggctattggataatagtgctgtagatgccttcgttcagtacttttagagcttgctgcacgctctggttcgtgctgttcatcacctggaagtattcgttcatgtcccataggtcacgggctatcaaggctttaagttgtgtcttgatgagcggtagggattggttgtactgtttctcgtcaaacttgattttctctttgtcggcaagcgtacgtatttcggcaaggaagttatcgtctatctcgaacttctcgttgaaggcttcgaatttcttgtatttgttctgcaactccttccggtgcttctcgatgtagccggtagtggctttgataaccacgcctttggctacgaggttgcggtgatagtctgtgtactgggtagtgtcgatggggacgaagaagtcgggcatgatacctccacctccgtaaacggtacgtcccatacgcttggtctgtgctttcagggagtcggcaaaatggatactgtccgcatgaatcatttctccatgattgaagcggtctatcagttcctggttatacttatcctgactgttctcgccggttaggcggccgtcgaggttggcagtgctgtcgtaaggcttctggatacaacggcccgaaggagtatagtagcgggcgatagtgaggcgaatcatggaaccgtccggcaggtcgataggacgctgtaccaatcccttgccgaaggtgcggcgtcctactaccacgcctctgtcccagtcctggatggctccggtcacgatttcactggcagaagcggagtactcgtccaccaatatgatgagacggccgttcttgaagttgcccgtacctttggcaaagaaatcactgcggcgtgcggcccttccttcggtgtagacgatgagttctttttgcttcagaaattcgttggcaaggtcgatggcggcattcagataccctcctccatttccttgcaggtcgaggatgaggtctttcattcctttcttttgcaggcttttcagggcttctgcaaactcttcggcggtggttgccccgaagcggttgatacggatatagccggttttgggttgtatcatgtaagatgcgtccaggctgaggatgggaattttgtcacgcttcacggtgaagtacagctggtcgtccacgccacggcgcacgatggtgagtttcacttccgagtctttcggtccgcgcaggcggctcataatatcttccgtgctcatttttactccggcaatggcgctgtcattgacggctacgatacggtcgccggcaaggatgcccaccttctcggaaggtccgttgctcacgggttgtatcacaagcagggtatcttctatcatctgaaactgtacgccgatgccctcgaaattgccttgcaacggctcgttcatcttcttcacttcttcggcgttgttgtaggtggagtgcgggtcgagttgtgccagcatcttgatgatggcttcttccaccagcttgtcttcatccaccttgtccacataaaggttggtgatggcaaactctgccatttgcagtttgcgcagggcttcattgttcggcttttgcgcttgtgccgtcaccgtgcatatacatattataatagtaaatagttttttcatcatttccattttaatccctaatcctttatccttaatccctaatctccattccctccggtatgaacatgcttatgtccttgccgtattgcagcagttcgcgcacggtggtggaactgacgcaggtaagttccggctcggtgaagagcaggatggtttctatgccggtcagtttgcggttgatgtcggcaatggtttcctcgtattcgaaatccttcacggtgcgtatgccgcgtattatcagactggcatctacctgccgggcaaagtcgatagtcaggcagtcataggactgcacaatgatgcgcggctcgttccggtagtagtctcgtatcatttgttcgcgcttttccaaggggaaatacgtattcttattttcattgatgccgatgcctatgacgatttcgtctataaaagtcagtgcacggctcactaccgaagagtgtccgatagtaaacgggtcgaatgttcccggaaagatagctcttctcatgatgccaaatcttcttctataaccaagttgttgataataaagttttgtcgttccatggtattcttacccatgtagaattccagcagctcttttacgaggtctgtcttgcgcagggacacttgttccagacgcatatccttgccgataaaatgcttgaactcgtcgggcgagatttctcccagacctttgaatcgggtgatttcggggttgggacccagttcttcaatggctttcacacgttcctcctctgtatagcaataacttgtcttctttttgttgcgcacgcggaagagaggggtttgcaggatatatacatgccctttctttatcaggtcggggaagaactgcaggaagaaggtgatgatgagcaggcggatgtgcatgccgtccacatcggcatcggtagctacgatgactttgttgtagcgcagtgtctctatgccgtcttctatattcaaggctgcttgaagcaagttgaattcttcgttttcataaactactttcttggtgagtccgtaggaatttagcggtttaccacgcaggctgaatactgcttgggtattcacgtcgcggctcttggtgatggaaccgctggcggagtctccctcggtaatgaagatgcaggattcggtttcctggtctttgcctttaccgtcactcaagtggtagcggcagtcgcgcagcttgcggttgtgcaggttggctttcttggcgcgttcgcgtgccagcttggtgacgccggcaatggctttgcgctctttctcggagtcttgtatcttttgcagcatcacttcggccacaagcgggttcttgtggaggtagttgtccacttccgtcttgatgaagtctcctacgtatttgttcaccgtggggccggcgggcttgtgttcctgcggcgcggcaggccacatgttgttgctgcccagtttcgttttggtctggctctcgaacatgggttcctccacgtcgatggcaatggcggctaccagtccgttgcggatgtcggcatattcctggttcttgttgtagaactccttgatggtacgggcaatgtgttccttcaaggcagtctggtgtgtgccgccttgggtggtgtgttgcccgttgacaaaggagtagtactcttcgccgtattggttggtgtgtgtgaaggcaatctcgatgtcctctcctttcaggtggatgatgtcgtaaaggccttcgctggtcatgttgtctttcagcaagtcctccagcccgtggcgggaaacgatgcgctggccgttgtaaatgaaggtgaggcccgtattcaggtaggtgtagttgcgcagcagggtttctacgaactggttctggaaggaatagttcaagaagagtgtggcgtccggttcgaagaagatataggttccgctttcttctgtcgagtcttcggtcacatcactcaacagcgttcctttttcaaagatggcgatacgtaccttgccgtcgcggtagctgcgtacttcgaagcggctgctcagcgcattgactgccttgatacctacgccgttcagtccgacacttttcttgaaagccttcgagtcatatttacccccggtattcagtttgctgaccgcctctaccagtttgccttgcggaatgcctcgtccatagtcgcgtacgctgacacgcagactgtcttctatagtcacttctatacgctttccggcacccatcttgaactcgtcgatgctgttgtccatcacttctttcagcaacacatagatgccgtcatcgttctgtgagccgtcgcccagacggcctatgtacataccggaacggacacggatatgctccatgtcgtccaggtggcggatgttgtcgtcggtatattccacgctggaaacggggctctctgtgatattgttgtctgcttcttccagcggcagggtcatattgttgttatcttccataagtacgttattccttcatattgcgcattgcgacaaaggtaatgagaaattcgggggttcgcaaaaaaataatgtcttttatggacttctgacaagcttatattctggatttagaacttattttattcctttcacaaagcatcttctccgtttatgctgttccgtcttgaagtactcccactgcgcttgcaccttgccgttcagctccagctccggattactctcggcatactcgaaaccaagttgctgatagacggggataaggtcggagaacaacaatgcatttacccccttgttctgatactccggtttcacggcaaccagcagcaaatcgagcatcttgggatatttcttcaagaagatggtcttggccaggtgataccaacccataggaagcaggcgcccgtgggctttttgcaacgcttcggcgagtgacggcatggaaatgcctacggcaagcagctggtcatcggcatcggtaatcaatgtcaccatgcgtaggtcgaggatgggcaggtacatcttgacgtattggtcaatctgccgttggctcagtgcagaatagccatagagtggctgataggcttcgttcatcagttcgaagatggcctgaccgtagtcttgggcaatcttcttggcagatgtgtatttctttaccttgaggttatacttgcgctggatgaggtcggagatgcgcttgtgcttgtcgggtatggcgtcgggaatgtagattttgtactccacccaatcggcatccttctcaaagcccatgcgttccagatgttgcggatagtagggatagttataaatggtggccatggtgctgagctggtcgaatccttcgatgagcataccttcggcatcgaaatctgtgaatcccagcgggccttgtatatgtgtcattccccgttcttttccccattcttccacggtgcgaatcagggcatcggagacttccgcatcatcgatgaagtctatccagccgaagcggacttcctttttgttccaggtttggtttgccttgtggttgatgatggcagctacacgtcctacgattttaccttcccgataagccaggaaatagtcggcttcacaaaattcgaatgcagcgtttttcttcttgttgaaggtgttgagcatgtcatcgaaaaggtcggggacggaataggggttgtttttgtatagcaggtagttgaaacggataaagcgctccagttcccgtcttgtggttactttcttgattgtaattgccatagttgttcaatattgagaccacaaaggtaatgcaaactgagagcagaacaaaataagcttgcttattttttatgccgaggtacagcttgccttatttaaaaatacgtgataatctttaaaataccgcgtagggtgtttgtaaatttgctgttagaggttgtatatcagtaccgctgtgtaggcaatgtagcagagaatcagaatgcttccttccacccgggtgatgatgcgtttcccgaaaaagataccgaacagccaaagcaggatgctggaccctacgagtacccacaaatcgaaattggtgatgcccgtcagacgcagtggagtgatggaggccgaacaacccagtacgaagaatatattgaagagattacttccgatgacgtttccgatggctatttcggggtttttcttcaaggcggctacgatggaggtggcgagttcgggtaatgaagtgccgcctgctacgagcgtgagaccgatgatggattcgctgacacccaatccgcgggctatgccgctggcaccgtctacaaagaaattacctccgatgatgaggccggcaagtccgccgagaatgtatagggcggacttccacgcgggtaacagcctgatttcgtcttcttcctgtaagtgctccttttccggttccttcatacttccatccctttttgcaatggcaaaagtataactcaggaaaatggtaaagaagcatagcagcaataggccgtcggtgatgctgagtatgttctccccactgctgtccagtaagacgtcgttggcacaaatcagcagggcgaaggatgaaaggatgcaaagggggatttcgcgtttcagtgtgttacgggtaatggctatcggggcaaaaagggccgtacaacccacaatcatcagggtattgaacgtattgcttcccaccacattgccaatggcaatgtctgcactgcctttgagagcagaggatatgctgacggtgagttccggtgcggaagtgccgaaggcaacaatggtaagcccgatgacgatggacggtatatggaaacgtttggcaacggatgcggcaccgtctgtcaagccattggcacccagaagaatgaggagcagtcctccgacaagaaacaatatatccataggtatgtcaattttgagtacaaagatagtgcaaaccggatacagaactttcatgtttgcatgaaaaagttatgtcgattagagtaggaagttaaaaacattccgtatgtttgaagcatttattgggtatatttgcaaagaatcaaatcaagaagtttatatatgaaggttatccgtgctttctgtctttgttggctgttgatgctggcggacggagtgtcagctcagttggtagataaagtgctcagtgttttaggtgaggatagtgtggggagtgtcacagtggcaaggactgactccgattcgattcagttgtcgcttgtccggcaggagttggaaacagcctggctgaatgaggcgaacctgcggatggaaatggagcagatgaagttggcgggctatgcggccgattcggtgaagctggcattgcagaaacaacgcattgattcgttgcggacggtgacaccgggtattccggtggtggtggagaaggacactttgttctatctgtatgccaagcgtggagggcatacgccccaacagcgagccaaagatgtaagcaacgtcatcgaagcattgggtacgcgtttcaatctgtgtccggactctgtttatttagagagtacggatattgttacagacttgatgtatggcgaaaaggtcatcatttcctttaccgatcaggatgctttgtgggaaaactgtacccgcgaccagctggccgccagcaagaggcatgtcgtggtggacaaactgaaagccatgcagaaggagcatagcttgtggcagttgggtaagcgtatcttgtactttatcctggtgcttgtgggacagttcttcttgttcaagtttaccaactggctgttcagaaaactcaaactacgcattcagaagctgaaggataccaagctgaaaccgatctctattcaggattatgaattgctggatacgcagaagcaggtcaatctgctggtgtttgttgccaacctggtgcgttatgtagtcatgctgttgcagttgctgctgacggttccgttattattctccattttccctcagaccaagagcttggcttatacattattctcctacatctggaatcctataaaggttattctgaatggaataaccgactatatacccaatctgttcacaatctttgtgatatgctatgcggtgaagtacctggtcagactggtgcgctatcttgccaatgaggtgcaggctgaacggctgaagataaacggcttctatccggattgggccattcctacctatcatattgtgcgcttcttgctttatgcgtttatgattgccatgatttacccttatctgccgggttccaagtcgggagtcttccagggaatctccgtgtttgtcggcttgattgtttcgctcggttccagtacggttatcggcaatatcattgcaggactggtcataacctacatgcggcctttcaagctgggtgaccgcatcaagctgaacgatactacgggcaacatcattgagaaaacaccgctcgtcacccgcatccgtactccgaagaatgaggtggtgaccattccgaactctttcatcatgtcttcccatacggtcaattacagccagtctgcccgtgagtatggattgattatccattcggaggtcagtattggctacgatgttccgtggcggaagacacatcagctgttgatagaggctgcattgaatactcctggagtgatagatgacccccgtccgtttgtattggagacttcccttcaggattattatccggtttatcaagtgaatgcctatatcagggatgccaacagccttagccagatttattctgatttgcatcagaatatctaggatgccttcaacgaagcaggcatcgaaatcatgtctcctcactacatagctacgcgtgacggcagtgagacgaccatacccaaggatgacttacgggagaaaaagcagtaagggagccggttatcgtgccagtaaaatctctgcaaacggtacgtagaacataaacatcctccattcctttgtctggaaatcataagtttcgatgaagtcgccttcacgatagcctgcaaactgcacgtagagtttccttgtctgcccgtccttggagtagtacatggcagcggagcgtacggcgttggggtaggtggcgaaaggctctttcaagtttccggcagtagtatcccataagcagaattgcgtatctccaccattggcacgggaaacgatatagcctcctttgcattgcaggctgtttgggttttcgggggatggttccataatccggaaaggtatcaaggcttcggccttgatggggtcgtagcaatgcatcttttctttggcgatgtctatcacgacgggcgagaaggtgccgtcgccgttgttggccgagagcagcatgtgggcgtcggctatcacgcccggatagcgtgagagggattcgggcttcagtccatccggtaatggtatttcgggagtatgtatcggtggcatattcaaccgggtatataccggataagagatgctacagtaggtgaggagcttatctccggccatttccagggaaacagtgttgttgaagtccgagcagatggtaattgcgttacgttctaccgggttacaccaatagtgcatgcagaggtcgtatccgtcgatgaaactactgccgtctttctcccgtatcccgcagaggatattggtgccggggatgttggcggcaaggtggaaatcttcgtcgtcatggaactggattacttccgatatttcttgtgttaccaggtcgatacgggtgatgccgcggggaacggtcggtgtgtaaatggcgtgggagttggtgataccgtagagatatggttcttcgggggattgtccgtcggctaccgaaatctggccgagaggctgaagctgtcctgcccgttccaggaacatttctacccgtgaggcgggccagtgtccgggggcaaggaaagtaatgctgttggtggtttgctccgtggtaacggcgcgtgtgtagcgtgaatacccttcgggaaagagaggattgtcggctatcggccagtagatgtccaatatgatttggtcgccgctctgcaagccgtcggctttgacggtcacggcatcaccgggattgaaggtctttccggcatcggatatggtgatattggtcacaaaagcgggttgtttctctttgtcgtcatcactgcaagcggcaagtagcaggctgattagtagcaggaagtgtatcttcttcatcatagttatgtattgacaaatgcaaatatagggctttttcttgtattcctgcggataggctttgtttttgtcgtatgagatggaaaaatcctcctacgaaacatggtcttttgcttcgtgggaggaaagtggttgttcggcagggcttcgggggaatgcgcctgtttgcgtgccggcttggattatttgctgcgcgtcaccgtgtgcaatacattccctttcttgtcaatcatgcgcagttccagtgtctttttgctggccgatacaatggagaaacccggttcggggctgcagaatacggtcccttcgatgggcttcaccttgcgggcgagcgaaccggcagaattggtgatatagtcgatgtcgctgcctgccacgcgtacgtgctggaagttgtggatgtgcccgcagatgtacatatccaccttgtgcttgcgcaggatgggatcgagacgtgcctgcatatccgcgcgttcgctctcgtccttcggggtttcggcatagatgggatggtgtccggcaacgataactcagtcctctttggcggcagtcagtacggaatctatccaggaaagttgttgctggtaatcctgcttgcaggcatcgggataggtctcgctttcgttgcggtatttgtcaatcatcggggcggtgtctacccaaaggatgcggatggtagcgccgttgtcctcgaacgtcttggtataataacgggcgggcatggtccagcggcggctgatattactgtagtcgagcacagcctgcgtattaccgcggtattcgtggttgcccagcaggggaaaccagtctatcatcagctccgggtggctgtaaataagttcgtagttggtcatccaaagcggatcgttcacgctacgtacgccttcaaagtggtgtacatcgccggtggcaagaacgaattcggggcctacttcttctgccatttgtcccatcagttcggcgatgggcttttggtcgtagtagccgttacggccgaggtcgttggctacgtagaagttgaacttcttgtcgaagatggagtaatcggtgatttgggcaatggctgcgttgccgagtagggcaataaacagtaaaaggaatattttcttcattgtcattattaaattgttgagtagttaatgttgataacttgttgagatagaattcgctgtttaaaaattaatcttcactcccgcattcactttcacgccgtagtattctgcctgcatggtacggtcttttgtgccctggtagtagcgtagcggctggttcagcaggttgttggcttcggcgtagaaggtagtcttgaacttctttccgaaggtatagctggcgtttacgtccatatagttcaccttgtcgtagtagcggtcgtagaaggtgctttctcccatttcgtcgatgaaatcggaagcgaagttatagctcaggcgcagattcagaccgcctttctcaaagtatagggaagcatttgcggtatgctccggagagcctggcatgctcaagtctttctcattctcgcgaccttcgaagttgaagtcttccacacgggagtgggtgtaggtgtacgttccgtagaaacctacacatttcagagcgggagcaatgaagctgaagtcgcgctggtaggataactctacccctaccaggttggcgttgcccgcattcttgggttgggtgaagcgggtgtaggtgttaccctggtattcgtagttggtgctcacctggtctacgatgaagtcgtctatcttcttgtagaagatgccggcgcttatcagaccgatgctgcggaagtagtagtcggcactcaagtcgaagttgtaggagacggtaggtttcagctccgggtttccgatggtgatttcgttgtcggaacgcttgatgttcacactgggcacgagggccgagtatttggggcgtgacaaggtttgggtaaacgaaccgcgcactttgaagtcatcgtttacattccactttacgagcagcgacggcaggaagttgatgtagctgttgcgctgacggtcggtcttgctggtgaggtcttcgtcggcatcgtaggtgcgtcccgtataggcaaggttggtgttctctatgcgaagtccggtcatcagttccacgtcttttgtcagtttttggtcgaagcggaggtagccggaagtcacggtttcgcgggcgttgaagtttccggcaagttcttcctgtacctgctctttctcaaagagggaagcgttgttcaagtctaaagagccggtgtattccttgctggcgtagatgcctgcctggtatttgttgttgggcatgaagttcttgttggtctggtccactgtatttgctaggctgttcgtcatgaaggcatcctcgtccagaggagagtattcgtagaagtccacttctttatccttggtcttgcgcactacctttgcgccgaacttcagcttgttgccgttcttgaagggaagtttgaagttggcggagaacttcaggtcctgctccttgatgtcttcctgctgttccgtcagctctttcaggctgaattcatcgttcaatgtcatggtagagcctgttttggggctggcaaagggttggcgttcgtcgctcaggtccatgtcgaacttctgtttcttcagttggaagtcgatgtagcgttcgttgggacgttcttcgctggctttggcatagctggcgtgccagtccatggagagggcgccgaagaggtgttcgccgccgagggcaaagtccatggtgcgctggcgttccaggcgggcgttacggttgtccggcgtaccggctttggtctgtatgcgtacggtggcgttgccgtcggggtcaaggtctttcagcgtggtacggtagcggttctcccagtcgttgcggttgttgaagatgcctttgaaggtgagtttgtggttggcattgatgtcccagtccagtgcggcggagtagctttggcgttcgcgggtgacgtagtattggcggatttggtagtcgttgacgtacgtcttgccgttgtcatcctgctcccatacaaattcggtgtcgtaggaaccagaaggtgagttctgataggaggccgatacaatcaagccgagtttgtcgttgaagaagcggtcgccgtaggtgaagccaaggttcagttgcgccttttcgctcacccagttgtagccggttccggcggtggcggcaatggtacgcttgtagggggagttcttggtgacgaggttgatgctgccgccgatggcgtcgccgtccatatcggcggttactaccttgttcacttcgatggtctgaatcatgtctgccggaatgaggtcgagctgtacgttgcgcgtatcgccttcggcagagggaacgcggttgccgttgatggtgacggagctgaggtcggcactcgtgccccgcacttgcccgaagcgtgcctcgccttggtcgtactgcacgttgatgccggagatgcgtttaagggcgtcaccgatgttggagtcggggaacttgcctacctggtcggcagagactacattcgtaatccccatgttgtttttctgtgagttgatggcacggcgctgtccctggaaggcgccgcctaccaccacttcctgcaactccacgccttcgttcagtacgacgtctttttccagtgtacggcctgcggggatggtgattttcagttctacgggagagtagcccacgtagctcacctttactgtataggttcccgggtcaaggttagagaaagtgtagaagccgttgacgtcgctcgtcacgccagtgtgtagtttctcgatgtagatggatgcgcccgggagagtttgtttagtggcgtcgatgatgcgtccacgtacagttccttgtttcgtgacatttgctttttcgtcggcaatggccgtattgacggtggcggtgaataggagtaagaataagaatgctctcaaaatctgtttcatacttgttattatctgttaataatctgccgcaaaagtagagggttgccgttacgtggagattgcggagcgttgaagaacagataacgattcagttacaatgaggttacataaattcttggaggtagtaccctttcggcggtatctccctttgccgtcatctggcagactgatgctaaagatgcacgagatgtgcatctcggactgtatgagatgtacatatcgagcaacatgagatgtacatctcgtgcaggggaaggtataggggttggtgtcttatcccgtagcctggcagcggataagtaccttcttctcgtctgccagagtagtggcaaagagataagtgcctcccccttcggccaatttcagtcgtttgcgcagttcggccacggtggcggggaagttgcgcacggtgaggttcgcctttttctcggcagccagcatctctttcacttctttcttgccgaagccgcaggaggaggtaatccggaacttgcggccggggaagtccggcaggaagtggtccgaggtgtagaggtggctgttgggatgcagtttttccaccttatacaatgaggagaggctgcggaatgcaccggctttcagcacggaggcattcggttcgtagaggtatgatttcagttgaggggtgtaggggcatgcacgctccttctcctgccggcgggtgaagacgagggcttggggagccggtacaccggtgaagttgacgcaatggatggggatgtcgtctgccggcactccttcgccttgtcccagcaagagcagcagttccttgcattcgttgcccacggagacgatgtgtgcctctcgtacatgcttcaaatcgttcagggcaagggtgaggtcgagcatgggggagagttttaccagtacgtgtcttgccttgcgcagcagcagttcttcgagggcggctatatcgggttcgcagtcgccgatggctacggtctttccgccgtgtccgtcgcggcgggcagggtctataaatatacagtccacgggttccatctcttgcagatggcggacgctgtctgcgtggcagacggagatgtggttcaggccgaggacagggaagttgtgcgcggctatctggcagagggtttcctggcgctcgacgtaagtggcatgcccgaagcgggaggagagataggcgcagtcgatgccgaaacctccggtgaggtcggtaaaggtgccggctgatgcgggggtactgttctgcgcgggatgttcttgttctgtatgtagcaggttagttataatctccgctttatactgtgccgttgcttgggaggagcattgttccagagaaaggtgggcggggtagagtatatgctcgttctcggcccatgcgggtatcttctctttggcaatttgccagccggaaatctgtgtgatggcggcgggcatgtctaccgaagggtagcggcgtgcctgcaaggcaaggctgcgcacgtcgtcgcggcgatgctcgcggatgaagcggagggtgtcttgggataaaggcatggcttggcttatttattctgatgcaaagttatctcaaaaaggacaaagtggggcataaattcgcagctttctgtctgattatttttcagacacagatgacgctgataatacagattaagaatattaaaaatccgcgtcatccgcgtcatctgcgtcatccgcgtcaaagcgatagcaaatttaagtttccggacaagctgggggtgagagttaagggatgacccggtatcgctcctttgccgtctgcctgctgacgcggttgaagtgccaccattcgctgggtagcgggtggaatccggcttctttcattacctgccggagcagcagccggttttcacgttcttgttctgtcagcttgccttgtgccacgagcacggcttcttctgtgatgtgggcttccctgcccagatggtctaccggggtgcccatgggcagaggagttcctttatcgtcgagtatgctgatgtccaccgccaatccgtagttgtgcaggccgccgccgcgtgaggggttggagacatagatgtatttggaggttcctttcactacgttccacatcttctgctgtacggacaaggggcgcgctgcgtcgtagacgatgaggctgtagccggggtactgttctttcagtaggcgttgtgcccgcttcaggcttttcatggcatcggggtgcaggtaggcttctttcaggtcttcgtacaatagggttccggtgaagttgtcggcacgggtgtacatcaagtcgatggcgatgctgctgtccgcttcggcgatgttgacgaaaccgagggagtccaggtagcgggctgtccggcttttagccggagccggagggacgggtgccgctatggtgtcggcgtacgggatggtggtctccgtatccgggtcttgtgtctgctttggcgcttgttttctgctacaaccgcatagtgagcagccaagcagcagatataacaagtaaaagaaatatcgttccatcttacaaggcattcttggcggtaaggattgatttcatcaaagctatgtccgaactgacttctccctgcatcaagtatttgtttttccgttggcaggtggcttcgtaaatctcctttgcctttgctgtgtccttgtcccggtagagtgccagggcgcagagcagtcgctgtttggaagacgtcacatccttatattgccggatgtaggtatccagctcatcggtatataattcttctgcccgtgcggtcctctttgtcaccagtgcggtgaagagcagctcgcaagcgttttcctttatcaaaagtccgatgacttcgtgccggtggctcattattttctcaaatgcattgtaggcggcttcccattcttcgcagtcgagcaggcgcgaggcgctcatcaaggctatggtgacctgcagggcatctttgtagttgatgtcttccgtttggctgaaccattcggcaggcatgtccttaggacgcatgccctcttgcaccagtgcgttgatgcgcagctgggtgaccaatgcctgcttgctcttgctgtccttgagaagcaggcgcatgttgtcggcatcattgccgatgccgcccatcttcatggggatgccgttcatccctgcaaggagaatgccaatcagagagagcatcagaaggaagaatttcagcaggtaaggcagcccgtctacggtcagcagggggaggaaggcaaggatggcggtcagcaggttggcaagcactccacccaggttgtacaaggtggttgggatatcttcaagaggcctttcgggtggggtaagcaggcattggcctcccgttccggcaaggctgaaacgcttgatgcataatttcccgtctttccgtatgaaggtaaggttgaagatgcggaaggagacgaagcggtagccggttgccagtccgcagacaagatgcccgctttcgtgcagaagcacttgcaggaagatggagaacagcagaatcagtatggctaacaaggaaactcctactgtctccagcatgccggtttcggcaaacttgctgtgtaaaccgtcgaacgagtctcccaaaaccaggactcttacacctattactcctacgaaaccgatgcatgccccgaccatgaatcctccggccaatttaagtactttcttcatcctgatatcttgataaatgtgtttgccggcaaaggtaaaggattttatctgaaatgcaacagcttcccatgtatcataaaaagaaagagattgtgattgccacaacctctttccgtcacctaaacccactacgcaggctacagatagggaattatagtaatatagatacccgtaatgatggctgaagtgattactcctgaaatattagcccccaaggcatctcccaagatgaaggaattggggttgtccttgcttactatcttctgggcaaccttcgccgtagtaggcacgcagctcacggctgcaattccgatgaccggattgtaattgccccgcttgatgaagtacatgatgtaccctccaatgattccgccgataccggagagcaacagtgcgcccatgcccaataccaacaatttaagaattttagggtcgagcagcagatgtgcgtcgcaaagtacgcccaacaacaggccgagcatgaaagtagaaccatacaacagcggaccgcttacaaaatcgtagatatgcttcatccccgactcgcgtactgccactccgaggaacaaggagaagaacagcggtgaggcaaccgggaacagaaaacacagtacagcacacaatatagccgagaaagccagttttactttggcatcatagtttttgggcggcttcttgctcgtcatcttgatggcgcgcaggcgtttcggtaccagcagcttcaccagataggggtaaccgccatatgtcagtcccagatagagataggccactaccgtgatgggtacaaacagatgtttggccagggccaaggaagtgaaaagcaccatcggcccgtccgcacctcctaccatggctacggaagcgctttctttcaaggacagtcccaatgcagatgcgatgggtacagtcaggaaagttcccaattcggcacatagggcaaggaatatgctggcaaacggtttctgtagcaggaagcccacgtcgagcagggtaccgatacccataaatacgaagcatgcaatcaatccgttgctgaaggtcagggtgtagaccggttgcaggaagtctatctgcatggtgttcatcaagtcgtccgtatccgaaagcatcgggtccagaaagagattccccaatgtgccgtcgggcatgaaaagggtgccgcaattgatggcgaccatacccagtcccatgggaatcatgaccatcggctccagtacgcctttccatcccaggtatatgagcagcaggcccagggctattagaaatacacgggcagaggagagtagccagccgctttccatcattgttccgaatccttggaacaaggttgcaaaatctatattctccataattagtctttgtttttggtgtcgttgttctttttagtcttgttcttgttgtcacggtggctgatggcatcttccagatacatcataagggtatcttctgggtagaagtagtctaccaggtttcttttggagacaccgtggcttactccgtggtaatagcctcgaggcttttcgttttcacggtccacaccccggctgtagtcttcgcgcgtgtcgttgccgaagatgtttccgtgcatggagggggtgtgtagcatcagttccatcttctggcggaacttctttatgcggtgcaggcggagtaactcctgctggtgggaactgtagaaatcgagtgaatcggctgcgctggctatcagtttgatgatgaatgccacaaagaaaccgattgcaaaagtgagccccatcatctcaagggtggggaggaataaatcggacatagttatgatattaatgtgatgaaatggataataaaaaagcgaaagatgtacatgcagtacacctccggtaatggtttgcaataagtccgataaagtctaaatcaggatatgcagcagtgcatagatatagtatccgcaggaatagcggagagcattgggattgaatgaaaggttggcgctctctccggcagacagatggctggaaagcagatgctccagttgcccggctggtttcagaattctcatcttcaggaatttcggagaggcgtggttatgtgtgtataggctgttcggacacaacgcttcgttggtccagcagtcggtattttcgtcattgaatagtgaacggtgggtggctgtgtacgatgcgcactgtgtgtaggcggtaaaggagcattcggaggccggacttccgacaactattcccgccggactcccggtagtattccgtgagtctggctgttcctcctgggagatggtagtcaaacccagacagaggaaggtaaacataagtatgtaatacagatgtttcatcatagcaagataaaggaacaaataactttggacaaagttatatattccgctgtattttaagattaattgtctttttcctctgcaggaagtattctgaaggactggttgcggcatttatatgcccaaccgttccttcagtaaccggtatctggagaggcttacccgtagcttgacgccactttttaacgtcacttggtaggtctcttttccatactgttctactcgtgatatctgggttacgttgacaatgctcgagcggtggatgcggacaaagttatctgctggcaaatgtgtctcgaagtttttcatggtctgttccttgatgtactctccgtcggatgtcaccagggttgcgtagtccccacaagcctggatgtataataggtcttccactttgatgatgtgaatccgggagccgtcttttatcgtgatccggtcaatactttcttcttgtggcaggggagcggccttttctacctcgggggcggtgaatttttctgtttgtaatgaagtgtctgccacaatctgcagatgataccacaaaaggatagctgtccaggcaggaataccgaacaagaggcggaaaggaatgcttgtttggcaggtgtgccttgccagcgtttgtcttcacatccgccgcaaaagcaactgcattctatgcgtacttgccagtcggcgggtatgtgcagttccactcctccccaactgcagtccaggtctatgtaggtttctccgggtgctatgttcctcttgctctcccattctcttgttcatcatccgttgtaccatcttggcacggcgatgcactgtcctttggtgtgtccagtttctcctatggtgatgtctgagaaggaagatgccgatgaggataagggccaagggccacagcatggcttggaaattgccggggaatagcaataagcctgaaaggataaagaacgaggcggtcagcactttgccggagcctgcataggatgggaatcggtgaatccggagttatctgttcctccaccaataccagatgaagcgtagcccggtgccgagaagcgcgagagaaagtccggtatagaacactgcgatgaaggagtcgggcagaaggtggcaggtacgtattacaattcccattgcaatcatgcctatcatgacaatccatccttttacgtcgaaaaaggaaaaggggcagtgcttacctttcttctgtgagatacggagagtatgtttcttgtacagcctatggaaaataatgccgaagaacagaaggaataccaggctggcttcgcagactttgaatagccaataatgtccgtcatctatccagcaggtcaggcctatacgcagaatattgactcctgccaatgaccatatggttccggcagttatgagcagtgtatttggagatactccgtatttcatgatgaaggttgttttattacacaaataccgggcttgtatggcggagtccaaaaattaaaagaggctctattctattaagaatgagcctcttgtttgtggaccagcctgggcttgaaccagggacctccagattatgagtctgttgctctaaccaactgagctgcctcgttatcaacacgttaattatctctgtgtaagttctgaggtcaacaataggtcaacactgaacttattatgcaaatttactaaaaatcttattcacaatgaaacattctccattgtgatttgctttggacaagaataatcactaattttgtgttattctaaaacagggagttatgtcaagagatgtggtaaaacaagaactattggcgaaactgaagcaagaacactgcttttggtcgtacaatgaaaacttaatcaaggatattccagatgatatgctgattgagaaaaccttgttacatcttgacttggaagaaataaaccaactgtttctaatttatcctttcaagaaaattaagcaggtgtggctggattatcttgttccccaagcggaatatctctacacgttgaatcgtttttttgcatggtattatttcaaggcaaagaagccagatgcttatataaagtctatggctacccgccatcttaataaaatgtttgcatgaaaggtttagctccacacacgctgcaagtttttgaagccgtttctaagttggactgcatcaaaccctatctcttggtaggtggcacagctttgtcattgcaaatgggaactcgacaaagtgaggacttggactttatgaaatggcgtacctctaaaacagagaaaatggaagtggcatggtatcagatagagaaagagctcgctgtaataggtgatattcagcataaggacattttagatatagaccatgtggggtatttagtgtctggagtaaagttctccttttatgcctgtcctaaatattctcctgtaagtatgcctgtggaatatctgaataatctcagattggcagatgtaaagtctattggagctatgaagatggaggtgatgctacgcaggagtaattttcgcgattattatgatatttattccatcttaaagtctggtgtacctatcaacgatttggtatctttagcccttacctactctggacataaattgaaatccaagaatctgttagctatgctcaccaacggctctcgttttacaagagattcccattttgagcaacttgcaccgatttatgctgtaactgctcaagaaatagaagattatataaagttttgtttattataaactgctgcaacattcttgcgaatgggattatatatagaagtattccttgaaattgtagtagctttataaaaagaaaaacagcataagagtttcctcaaatgctgctctgtcttaagtagattggtaattagtcaatcttcttgtaagtggttgttgtaatgtcatccaattcctcgctaccatcatccattgtgtcccaatcctcaaaggcgagaaccaacttagtagctgtaagttcattaacagttaggacatctgaataaccatcatcgtaagagatagtcagcttattgtctttcaaagaccaacgacttgtttctgtatatccaccgtccgcatagccttctgtgcaagtaccgtcagctttgaactcccataaaccattggtatatgcttcatcagaagttactacttccttatcattctccactttgtgaatcttctcccaagtggtctgccatttacctataaggttagcttgttcaatgattgtctgttcatcttcatcatcactacatgctgtaaagtttacagccaacatgaccattaataaggtcgttccaattaatcttaaagttttcattgttgttaagatatagctcatctttagttatcttaacaacagtgtaaatggtattctcttctccccaatcagttgtataataagtaacgaacatatatctgttagggaagtattcaaatgtatcattttgagtgtcattttcgcctttctctgtataggtgttatccttattaaaggtaaggatttctccctctgctcaatgttcttcaattcgtcattgaccgtttcgatcaaggctctttttctgagcaaaatcttgtcggcaatactcatcagtgaattcttcatattgtttttaactttagtgacaagctgtatgccattaagaaaagggttctcaaacagagcctgaccaatatatcctttgtctgcacatagttttcctttgatgttctccagaaacttaccttgcttcaacggttcccggtcatccacgtttccaggcgtgaacatgaaattgagaatttcacccttgtcattgattatcagatgcaacttgaatccgaaggaccatcccattgaacattttccacgctcggcaagtccctcaaatgtcttatgaataaggattctttggttacgacaaacacgtaagggagtggagtcgacaaaactgatgccggtacaggttctcagcaggacttttttgatgaagatggtcatgggaagcaatacttccttctccagttccacaaaacggttaccttatatatattcttgaatttgggtttgtaggacaattccacttcacccacagtataatctatatccataatgtacgatatttaataggttggtagatataaagaaaggacaactaactgaatagctgccctttcctctctcaatcaacaatccacttagcccaagaaccaagcgtattcactatctcctaatttggcacgttggatgccttgtacaaactctgtgcaattaagattcctttccaagaagttatctatgtaacttgactttacagaaccattgagcgggtttaagagctgccaacctgtaatgctgtcccctgtactcttgaaattcacatcagaaacgaatgctctgcaagctgcattaatctgactatctcccaacaatagacgaggtaagcgtttctgttggttgggtgtaagagcttgatataatatcctttcactttaatattcaaatccactttcataaagaggtgggacagtgttataaagttggggcggtctatgggtaggatgcagtaaagacttctcattgtaaaatcaataagaggatggttgatggcttccctgtatctctttctaatataatcctgcctaatgttacttgtcctgttttgcaagtactttaattgtatcttcatattcattagttgctgattgaacattgttggtaaacactaaatatttttctcacgttccattttgtaatagtaggcagtgccaaaatatatcttggcttcctttctgttgtggaacttctttcctgttggtagatgaattatcatgtcagtttaaatattagtaaattaataagatagtttctgcaatgaaatataataggtagtaacctttccattcttttttctccttgtctttagatagttattaagattagcccacaatccaatgtgaaccttattatctttcactccctgtttaagagcctttgttcttatctgttcataagtaaattctttcattttagatattctgaatagtttgtagtctgcttatctgtgtggtgagattatctgtttgtggtacttattttggggtcaacaataggtcaacaacgaagcaaaacagcctgtttcttgtcagtatttcgaaaatccaaagagaagaagtcctaataaaaaagcctcataaacaagtgtttatgaggcaattctttgtggaccagcctgggcttgaaccagggacctccagattatgagtctgttgctctaaccaactgagctacaagtccgatgcatccttgcttggatagcggggacaaaagtagcattttctattgaaatatgcaagacttttggataaaattccttataacctttgtccttagaacttataagttcgttttggattcttgggaaaccagccttttttcactcgttcttcctgctcgaatatctccttgatggtccagaacgaggaaaatgcaaagacgcccaaaagggaggctatcatgatgttctccgtataaagggaggcaatgatgccgccgatgccgagtaaaaggaaaatccaccagcacttggtgccccaataatattcggctttcacaactatggggtgaaacaagccgatgatgaggaatgtgcagatacctatgacaaggcccgacagatgatattcgtttaagaaatccattgttgttcgttatttctcggggcaaataggaatctccttcttgatgctctgttccagggaaatcaaggtctcggtagcggttacgccaggaatctcctgcatcttgttgttcagcaaatccatcagatgctcgttgtcgcgggcatataccttggtcagcatggtgtacggaccagtggtgaagtggcattctacgatttcgggaatcttgcccagctcggcaactaccgtcttatacatggagcccttttccagcttgattcctacgtaagtgcaggttctgtatccaagggacttgggatttacatgatagcctgagccaacaataacgccaaggtcaatcaggcgctgtacacgttgatggatggcagcacgtgacacgccacattcagcagctacgtccttgaaagggatacgggcattttgggaaatgatttccagaatctgccggtcaagattgtctattttttccataatagtaaataagtaaagttcttgttgttatcaaatagtaagcaaatataggactttattttaatttatctataaaaagggacggaaaaatgaataaaagtgaggggtaacgataaggcgcggattacgcggatttcacggatttagtttaccaaatccgcgttattcctcgtaatccgcgcctaaaagaagtatcaagagggttttgcccctcccttcggattgttacattacttctcgatacccagcagttccacttcgaatatcaaagtagagaacggcttgatttggctaccggtttctcttgaaccgtatgccaggtcgtaggggatatagagttcccacttagagccgacgggcatcatggtgagggcctctgtccagcctttgattacctggttggcacggaaagtagcaggttcgttgcgcttgtaagagctattgaattctgttccgtcaatcagcgtacctttgtagtttactttcaccttgctgctgtcggcaggaacggcaccgttacccttggtgatgattttgtattgcagaccgctcggggtagttactacaccttctttagccttgttctcagccaggaacttttcaccggcagctttgttgtcagcatacttttctgcagttgctttttctttgatggcatccatctgagtacgcatgtactcttgagctttcatcatatccatagcaccacccttgccgatgacacctgctacgaaacctgccagcagattttcgcggctgatgctctgtgtggagtcgttgccgaagatttgttggttgaagccttccacccattgcttgctgaccatctggcctacttgcagaccggccatgtaagccacgtctttcttatcgattttggctgcgccttcgttgaaacctttcaggaattctgacatctgggttgagtcaatgccttgttgtgcaagatactggtccaaaccttctgtacgtgccataccgatggcgtaagataatgagtcgatgtccgtcttcaaatcagctttcggactttgagcagtacaagatgccatgccggcagctactgcaagagccatgagaaatgttacttttttcattttgcttttacttgtttgtttatttagataaaattttctgtaattcgacttcgaatacgagcgtgctgtggggaggaatcatctcgccggcaccctgcgctccgtatgccaggtcgctggggatgtagagtttccacttggcaccttcgggcataagctgaagggcttccacccaaccgggtatcacttggtttacaccgaatgtggcaggctggccgcgcttgatggagctgtcgaacagcgttccgtcaatcagtgtgccttcatagtggcattgtacctggtcggttgctttggcatagtgaccgacgtttccttctgtgataacttcgtattgaagtccgctgggaagcgtaacaactccctcgcgttttttgttctcttccaggaactttttgccggcttctatgtttgctgcgttcatcttctcctccagttcggcgaagtacttgttgacgatgtcacgggcttctgtgtggctgattgccgtctggttgccctccaaaacgtctttgattgcttgtgcaaagtcatctactgcaatgcctttggcacccatgcttaaaagattctgacctattccaaggccgatagcataactgaatttgtccataagattcttttgttgacgaccggattggtttcttttccagtctattgcaaatttatgagtggcaaaagtacgtcttttatttgaatgataaggcttttaagtatttaatttttcttatttatatcacaacttgaacattcttcttatatttgtcttactttaataaaggaaaggagcagaaaatgaagaacttggtcatattgtcgggtgccggtatgagcgccgagagcggcatcagcacattccgtgatgcgggcggattatgggacaaatatccggtggagcaggtggcgactcccgaggggtatgcacgtaatccggaactggtcattaatttctataacgaacgtcgcaagcagttgctcgatgtggtgccgaatgccgggcatctgggcgttgccgacctggagagggatttcaatgtaacggtcgtcacccagaacgtagataatctgcacgagcgtgccggcagtacgcacgtgatacacttgcatggggaactgacgaaggtttgttccagccgcgacccttataatccgcatttcgtcaaagaactggcgccggaggaatatgaagtaaagttgggtgacaaggcgggcgacggtacgcagctccgcccgttcatcgtgtggtttggcgagtcggtgccggagattgaaactgccatccggtatgtggagcaggcggacatcttcgtcatcatcggcaccagcctgaacgtttatcccgctgcgggactgctgaactacgtgccccgtgccgccgaagtgtatctgatagaccccaagccggtggacacgcacgtcatgcgtccgatacatgtcattcaaaagggagcttcggaaggggtaaaagagttgaaggcgctgcttacagctacccagcctcctttgccttaggacttaatctcctacgtcttaggacttagcccctcacggtataggacttaatatgcagaacatccggatgtctttctccaaaacacccggatgttttaccccaaaacatggggatgttttgccccattacatccggatgttttaggtgaaaacatggggatgttttgggtactcactcctatactgtagagaactgggtataagggagattcccgcaaggtataggtcttgcgggaacaaagtatatttgtcctcgaaatttgtgctatttctttatcacggcccgtaatacgaaccaggcatgatgggctacggtactcatcagtccgtaatgccgcgccatgatgcggaagcgttcgcgcagggatgcttgccggttctgggtggtcattccctcttccagatagtcgatgagggtgagatgggtattgtgcaaggtccgtgccttcttcatcacccggatgcaccagtcgaagtcggcggagaagcggtattgcaggtcgtagggttctacaagggaagctttggcaaagaaggcctgatggcagaccagcatgccctgcttgaagcttcgccaggtaagcacttccggggcggcgaggcggcgcatgcggatgaagtgaccttccttgtccaccagttccgtttcgccgtacagcacgtcgggtagttcgttgccggagatggaacgcaccatctgctgcaaggtgtcgtcctcgtggaagctgtcgccggcattaaggaagcagaggtaatcgccggtggcaaggcagatacctttgttcatggcgtcgtacagtcccttgtccggttcgctcacgatgcgggtgatgcggtcgcggtaacggtcgataatggagagcgtgctgtctttggacgcaccgtccacaatgatgtattctacgtggtggtaggtttgcgagataacgctttgaatcgtgtcctccagtaccgcttcggcattgtaggtcacggtgatgatgctgaatttcggggtggggtggttatgcatttcttccggtcactttgttgtaaaggtcaatgtatttcttggcgacgacgttctccgaatagtgggagatggctttccggcaggcttgttccgagaggctggggtagtcgggttcggtcagcgtccagtagatgccgttggcaaagtcttccgaggatttgtattgtgccacgtagccgttgtgcagatggtctatcatctcagggatgccgcccacgttgaatccgacgcagggaatgccgcatgccatggcttccatgatggtgttcggcaggttctcttccagcgagggggtcacgaagatgtccacggcattgtagatgttcaccagttggtgttcgttgctgacgaagttcagcgggtagactttgaatggaagcaggttttccagttgttgcgattggttgccgaagacgacgacacccaactgttcccggagttcgggatgcttgtcggccagcagtcggcacgattctatcaagtagtcaatgcctttccgtttgtccgtaatcttcaccgagccgaacagcatgagtttcttgtcttgcggcagcaggcaacggctgcgggcttcctgccggttgcggggcttgaagagattggtgttgatggggttggggatgcacgtcacggcatgtccgcagaagagggcgcttgtccgggcacgttcttccagccagcggctgcaggtgacgaagttgatgtgacggttgcgatacaatgcctgctttttgtggaagatgcggtaggaaaggtcacgtttgcctctgcctccgtggatgaaggggcagttgtggcattcctgctggtagtgggtgcactcgcgggcatggtgacagatgccagtgcagggccacatgtcgtgcatggtccagacgacgggcttgcccgaggcgagaatcttctcgatgttcttcagcgagagcatcccttggtttatccagtgcagatggatgacgtctgcttgctggaattcgggcagtgaggtgatgtctgtccccgtgttggctatgtccacggcaaagatgttctttttgttgaagcggttggcgctccagatgacgatgcgctcccagacgaacttccacaccatgcgccagttatggtccagtgacacaacggagatttggtcggtctgcttgtcgcgtaccagcagcttggctttgatgccgtggttcttgagtgattccatcagacggctggcggcgatggctgcgccgccgatgcgttcggatgtattgataagtagtactctcatgactgttgttcgtttcttcttttttgaatgttttttcttgttacagatgccggtcttgtttcatccatttccggatacgcttttgcagcgtttgccatatgatggtgaagttgccgtaccgtaggttcaacgccagttcctcgaacgaccgtgcaatctttatccagggatgccgccatgccatgatgcggtaaacgctatccttgtaggctgtgttctcgatgacgtggcgagggtgcttcagtggaaactccacttcgtggcgtttcatggtgaagatgcggcggtaaccgcgcggcatggtgtgcacggagccggcaaagtgggtggagtcggcagtggctcccagattgtttatcatgttgcgggtgggcacgatgctcagacccgaattgaacaacatggaagcgtggaagatggtttcgtaataggctttcccgtgttcgcggtggcgttggcacatgtagatgaagtctttgcggtagcgccgtgtgtggatgaggttcttcagttgccgcatgttctccttgtcgtccaggaaggtgtagaattcatcccattggtccgtcacccgccgccagctcgcccatccccagatggagaaggtggtggcgaagaagtagtcggaagtgatgtcgggtgtaatctcctcgttgttgaatccggcaattatgctgatgcgtgtgtcgtgctcatacttgtcgagcagttccttgcagaagccgaagaaagagacggcaggcacgtcgtcatcctcaagcacgatacatttgtccgacaaggagaatgcccacttctgtgccatgtattccgatgggtcgcagccgtagttcttctcttggtagttgtggtgtacttcgcattcccagtcgatgtctgccactactttgcgacaagcttctatgcccggcatgtcacgctcgccgcgcgggccgtcctgatagagaaacagtcgtgcggggcgtgctttcttcacttgttcgaatacttgcgccagcagtttggggcggttgaagaaaagaatcagtacagatacatctacaagggctggtttcatggcaattttgttggattaggaggtggctatatggtcatttggtatgttgaaagaaagaactgccggataatgattgtttatcttgtcctgctcttcttctgtataccggtgtaaagtgggatagttgtaccgtagaaagttttccaatccatcaggtgctttcagataaagtggaccgaatttgattggttgtaaatggttgagactcgtctccaaaacatggtcggtagtggtaatcacattgttgtaatacaaagttttccatgagttgaaacaactttgcattatcaccatcaaacggtagattgtctttttagagagtgtcatatcaactatccggttcagaaggcaggcaacagctccacgattggtagggttggatatttgacattttccgaagtgtttccatagccatacctcttttcccatcaggcagcatttcagaaagttgacagcttcatattgtatcttccttaatagcttattgtttggaatacggtcaaaagggaatatatcgacaaagattccttgatgcataggtacatctttaaacatctcttcgacaaataaggtgttgtttttcttgactttggcaaagtaataaggactatgagggtcggtatgtatccatgaaagaaagtatggctctctcagttcttgggaagctatctggagaaacttattgtagtcttcccgtttcatacctatatctatgttgtcatcccaaggaagaatcgctttgtcatagagtgcccctattgctgttccgccgattacaaaatagggaatattgtgtttgtcgcagatgcgcacaatctcttccagtatttcgtatagcacctgatgtagttgggtcagttcttctggggtatattgcttcaccatggataccatttttgattgatgtctgcaaaaataatgataatagttgaaaggagcactttccatttcaatcttcttttgcgaaatcggacttgagtttttctatcagtgtgtcggactccccgcttactactttccggcagaacatctttccagactgccgcaataccggcaggtcctcgagtgtcatcacgcggatggatgcgccgtagtctatgtagtgcaagggggtgagacgggtaagtccggggtattctccctctaaaagaagcccttttgaggcaaaaggggagttgaatacgatggtctgtatgcacagttcgctgggtacaaagctggttctgaaatacttcaccagcttctcctccgtgcacaacttttcatatacatatcgtgcgcagggcaacgtgatggcccaatagtcggaaccgaaatagacatctgcctgcttgccctccaagggtgcaaaaggggctttccggatggggagtatctgtgccagcttgcgcgatgctacgatgagtttgtttttccaccatatactcttccaaggcaggtcacggaaagggtggtaatgggttatcttgtgcaactgctgtttcacggtgcagcgtgtcaggttgaaaccgccgatgaattcagtgtcttgatgctcctcgaaatagtggtggatggcgttgttgttccataacggatagtcttgcccgctcaggcatactacgcgggtataggggataccactatgcaatacggcggcaagcaattctttctgatattccacttgttcccatcctccccagcttatccggtggcggggcacgaaagtgaccttgtctcccaaggcttcttcaaaagggtgtatatcggcattgaggtcgatgtgcacgtagaagtctgcccggtcatccagtgcggcaaccaggcgtgccaagtgtggggcatccttgtaggcggatatgatgtaggctatgcggctcatgctctttttttctttaagaggaattcaatgctttcccggaagatggtagattgtagtttccacaaaaccagtgcataaagcccagctaccataatgattttggctgccatatttaagtataggttttctatgggctgagtggcatagtgagttgacactacgagtacaatggatagggagagataaggagagatgtctttcagcatatcgcgcagtcttaatcctatctccctcttgacaaaacggaaccatacaaacagccagccgatattgataatgacgaaaatacgcagcatccactccaacccgtatgggtatatggcacatacagctactatttgcagcaggctcaagctgatggtgctccacatatagatagaagaatgtccccggctgatgagcaggttggagaacagattgatgacgggaataaatgctccccaaatacataacagttgcaagatatcggcactgggcagccacttctccgtgatagtgattataatcagttctttcgataccaagctcaatcccagcatggcggggaaagagataaaggcggtgaagcgcagcagctttctgaatacggcaagttgccgtgccttgtcgtcggcaacccgggtaaagacgggttgtgcaatgccgtttatcatgcccgtaatcgtggtatgtcccatgccgttccacttgtttgcctgcgtaaagttacccacttcccgttccgaatagaacttacccaacaagacggaaaacaaattgttattgattatggtgaagatattcgtaatgattatcttactgctgaaccctatcatctccttaatgggtgtgaagtcaaaccggaaacaaggcctccaacgcgagaagtagaaattgagaaccgtcatcacggtgacgaatgagatactttgcaatgcaataccccaataggcgaatccgttggcagccagtgtgatgcccacaatgccggagactatcagactcgaaatggagatgatggtagtgtccttgattctgagattcttgaacagatacgctctcggtgcaatgctcatgctggaaatgacgaatcccaagaaggagagacgggacagcggtatcagctcgggcgtatcgtagaagtcggcaatcagcggtgcggcaaagaagagtaatatatatatagtagtgctgcacatcaggctgaaccagaacacggcgttgtaatccttgtgcaaagtctccttccggttggtcagtgccgaaatgaacccaccctcctgcaaggcggcggcaatggcggagaagatggtaagcatccctaccataccataatccgaagcatccagcagacgggcaaggactattccgaatcccagatttaacaactgctgtatgccgttgctgaatcctccccagaagaggcctttggctgttttttctttgagtgatgtatcggacatagtttattggttgataaggcaacgagttaacaaggccacgaggcttttccttcctccttgtagccttgttaactcgttaccttgttactgttttatttcacctcgctgcccggcttcacctctttcagcagtgaagtcaccgccagcgagccgtcataattctcggcagagagaatcattccctcacttaccagcccgttcttgaattggcgtggagcgaggttggcgatgaacagcacttgcttgcctaccagttcttccgatttgtagtgctgggcaatgccgctgacgatggtgcggttttccagcccgtcggcaatcttgaacttcagcagcttcttcatcttgggcactgcctcgcattcaagcactgtacctacgcggatatccagcttttcaaagtcttcgaaggcgatggtcggcttgatggggtttgccttgtaggtggcggcttcatttgccttcttggtggcaagcagcttgtctacttgtgcctggatgacgtcgtcttctatcttttcgaacagcagttcgggggtgcccagctgatgtccggcaggcaacaggtcggtgtgtcccagctctgcccagtcaaagctgtccatgttcagcatcttgcgaagcttctcgctgctgaagggcaggaacggttcgaaagcaatggcaaggttggcgaccaactgcaacgagatgtggagaatggtggctacgcgctccatgtctgtcttggcaagcttccacggctcggtgtctgccaggtatttgtttccgatgcgggcaaggttcatcgcttccttctgtgcgtcgcggaatttgaatacgtccagcaacttctccacttctgccttgacgtcggcaaattctttcagcgtctcgcggtcgtagtcgttcagttcgcctgcggcgggcactacgctgtcgaagtacttcttggtgagttgcagggcgcggttcacgaagttgccataaacggcaaccagctcgttgttattacgtgcctggaagtccttccaggtgaagtcgttgtcttttgtctccggtgcgttggcggtcagcacgtagcgcagcacatcctgcttgccggggaagtcaacgagatactcgtgcagccataccgcccagttgcgtgaagtggaaatcttgtcgccctccaggttcaggaactcgttgctcggcacgttgtccggcaggatgtagctaccctctgccttcagcatggcggggaacacgatgcagtggaacacgatattgtcttttccgatgaagtgtaccagacgcgtttcggggtctttccaccatttctcccatgtgtcgggcagcaactctttggtgttgctgatgtagccgataggggcgtcgaaccatacatagagcactttgccctcggcgccctctacgggaacgggaataccccaatccaggtcgcggctcacggcacgcggctgcaagcccatgtcgagccagctcttgcattggccataaacattgggacgccactccttatggtcttccagaatccattggcgaagccattcctcgtgtttgtccagcggcagataccagtgcttcgtctcacgcatcacgggctggctgccgctgatggcactcttcggattaatcaggtccgtggggctgaggctggtgccgcacttctcgcattggtcgccgtaagcgccttcggcatggcagtgggggcactcgccggtgatgtagcggtcggcaaggaaggtcttagcttcttcgtcgtaatactgcatgctggtcttttcgatgaattctcccttatcgtacagcttgcggaagaagtcggaagccgtgtcgtgatgcgtctttgaagtagtacggctgtacacgtcgaaggaaacgccgaactcttcgaaagacttctttataagcgtatgatagcggtccaccacgtcttgcggggtgatgccttccttcttggcgcggatggtgatgggcactccgtgttcgtcggagccgccgatgaagattacatcttcctttttcagtcgcaggtagcggacgtagatgtctgcaggaacataaacgcctgccaggtgtccgatatgaaccgggccgttggcatacggcaatgccgatgtcacggtggtacgtttgaatttcttttccattgtgttattatgtatctcttttgttatgaacgcttttagtggcacaaagatagctgttttctgcaaaatatgagtattcttccagattctttccagatttaggcttcatctttgccatacaaaatgaacaaacttggtattgataatgtaaaaaaacgaaatgactatgaaactggaaaagtacttcttattattggcgttaggcgtgtttgcctttgccttgcaaagctgtgatgatgacgacaacgacggaatctccgtgcccgcggaactgagtaatgcgttggccaaggagcatcccaatgcccagcgtatagaatgggaaacaaaaggtgcatattatgtggctgatttccatgaggacaatttcgaaaaggaggcctggttcaccaaagacggtgtatggcagatgaccgaaaccgacctccgttatgcagaccttcccgctccggtgagaagctcttacgagagtagtacctattataatgtatggaaggtggaagatgtagacaagctggaacgtaaggaaatggctgttgtctacatcatcgaagtggagaaaggtaatcaggaaatggacctctattattcggaggacggcattctggtgaaggaagtggccgatgcgcacaacggcggttctcccgaagattatctcccttctgatatttccgctgccatcaaagattttatagcagagaaatatcccaatgcccgcattgtggatattgaaaaagaaaagaacggtatgacggaagtcgaaatcgtgcacggaagtatcagcaaggatgtgatgttcaccgctgagggtgcatgggcctatactatctgggatatcagtaagagacatctggaggatgtagtgaagaacgccgttacggctgcccatcccggttatgtcattgatgatgccgactttattgagactcccgatggcagttactttttggtagagatggagcaaggggaaagggaaatctacgtaaaggtgacagcggaaggtgaaatactgccatagtcttatactgaatacttccctttaaatcagcgtattgtatttaccgcttgtttaccttctaatgtaaagcagtttaccatagggtgtaacggccgttactccatattgtaacggtcgttacaccatagtgtaaagccttttacctcgtagtgtaaatgaagttaccgtttggggtaaccggagttatcatgtgaggtgaccggagccgtcatgtgaagtcgtactcttctacataagcgtcgaagtactccgcccgttggagtcctaagttacgggcaattgcaatgacttgttgctgctcggttggtgagagcaaagtttcccctttccgcttctgataatatcttcggataccccataagccgatgagccggtagcggaacgtgccggactggccgacagagatggcttctgccgtatggataaagcctttggcatagcgcactttcttattcgagcaataatatttgcattttcccgctgtggactctattgctttcggattcagtacatataggaagatgttgtttgagggtgcatacgtatatgcaatccggcgcaggcaggtgtcagtataagggcatgtgtcagtagcgcataagccgaagttatggggaactttggaataatcgaaagtttcttctttcatcatttttttgtttaaagttccgcaaaggtacaattagtttggagattgatgggtgcttcacctgatatttgttttatcccgaaaatattatgtattttacgtaacgtgaaatgcgtaacgtaaaacatggaatcattccgccttccggtttccgcatttcgtcctccccattccgcaccccgtccgtaaatgcttcccgcttacttgccgcaggcctatatttgcagaaaacatttgcatattcccatgaagacaaactctgtgattctattggtgttgtggcttgcggcgtggccgttctgctgccgggggcaaggctatatcagttacgactatctgcccgaaagttcgttgaaggatgacctcagcaacgagtatggttcgggcagcttgatgatggtatcgggaaggtataacctgccgctttccgtcaggcatgacgacaagggcaggctggtggcgtggtcggcaaccgtcaatgctgcctatggcgtattccataataaggggcaggcgcgggagttgaatccggacaatctgctgaatgccagtctgaatatctcccacatccgtcccctgtccgacaagtggagtatcatagcctctgtgggcggcggtgtctatgccccgttggacggggtttccatgaagactctactggctaatggagcaatcatctttgtctataaactgcggaagaacctcgacttgggcatcggtgcggggttgacgaactcttacggtatcccgatgatactgcccatgatgtacttcagttggaggaatgccggcaggtatgagctgaaagtggatatgtccagcggcatgaaagtgtccgtcgccacctggctgaacaagaagctgaagctggaactgaccgccctcgatatggacggcatgtctgccgtgatggaagtcgacgggaaatcgaaaatctattctaccgtcatgctgaggtcatacatcagtccttcgtaccagttgagtaggaagacggctgtttatctgggagtgggcggtaactggatacgcggaataagtatgtcggaccgtagtttgaaaggttttctcaataacttcaagaacgatgaggacgagccttgcttcagaccgactctgcgcctgacggtgggattcaggtatacgctgaaatgacaaatgccattttagtaaagacaagaggtaaaatagtatctttgtcgcaataacagacacgttttatggtaaagtatttattagtagaagatgagcgcttcgcctacgaagagctgaagcgtatgatgcaacggctgcgcccttcctggcagttggcgggctgggcagagagcgtggagcaggctgtactgctcttgcgtcagggcagcctggacttgatgattgtagatatccgcttgtccgacgggttgagctttgagatattcgagcagtgtcccgtcgatttgcccgttatcttcaccaccgcctacgacgaatatgccatcaaggctttcaaggtaaacagcatcgactatctgctgaaacccattgaagaaagcgacctagaagcagccttgtgcaagttcgagcgcaacagtgccctccgttctgcggctcccgaatatcggcaactggaactcggctacttggcagccaacaagaagaaccgttttctggtgcaggtaggcgataccttccgctacgtagaaactccggatgtcgctttcttttatagtgaggacaagttgacttatctgcacctcttctccgggaaacggtatatcatcagctactcgctggaccagttggagggaatgctggatagggatgttttctttagggtttcaaggagctgcatatccaacattaggtccatccggaagagttccaggtacttcggcagtcgcttgaagctttacttcgagccggagtgcccgcacgaggtattggtgagccgcagtcgcgtggccgatttcttgaaatgggtggacggagtggtatgagttataagttatgaggcataagagatacatattcctttttatactgacggtttccgtctcgttgcttgtcatagggtgcgtttataacgtcatcagcggtaagccgtggtatgcgaatatcatggtgcagttctttctgaatcttcctttgtgcatagggctggggttcatcgactttggggttatcaacttgatatataaaagactgaaacagcgcaacaatgcggtgaggattctggtggatatcgtgttgaccactgcactggctgttctgttgacgtacatcttgaacttcctgctgatgggcgggcatggaaatttctggcatatcctgagaaactccctgccggtagtgccgtggaactggattatcgttctgcagatagagatattcttctatagcctgcaacgttcggagatggagaagcagatggctgtcatcgagaaggagaaggcgctgtatcagttcgaggtgctgaaaaaccagattaatccccatttcttattcaatagtctgaatgtccttgcctcccttgcttatcaggataccgaaaagacgaaccggtttgccaagaagctgtctacggtgtaccgttatctgctcactacgcatggcagagctacggtgaccgtgcaggaagaactgtcgttcgtagagtcgtatttatacctggagcatatccgctttggcgatgcgctgcatgtggagatagaagatgatttgcggaatcatcattgtctcgtcattcctgccagcatacagatgcttgtggagaatgccttgaagcataatatcagtacaaagaagtcgccgctgatagtccatatatccataggaaacgaagggattacggtacgcaacaatcttcagttgcgcaactatgtggccagtaatagggcgggattgaagaacctgcaacggcagtatgccctatacggcacgctggtggagattcttaaggacgaaaaggagtttgtggtgaaacttccctttgtgggcgaagacgtgaaccgtctcagcacaatatagtcctcttcccgaagaagaatctggaaacgtgcatcttgtccatagcccacgccatacccatgcagccgctaagagtgaaggcggtggcagtgacaaggaacagcatccccgtagggtcgaaggcgaacacgggcagaaacgccttggacagaatggtgaaaatgggtgagaaaaggagtatgaccagcgtattgcgccctataaagaaggaaagccgtttggcttgtaccggcagatagccgtaggctgccaacagcaggctgatggaaagccaggtgatggcgactcctgccagagtacctctatccagattggcgggaaaacagcatagtattacgaatggaacaatggcgaaggttgtggcacgaaagacttgtgtaaaacgaagcccgctttggctcactgtcatgccgataaggaaatagagggcattggagaagttcatcaatcctccccaatgggaaagggcaaacaggcggacaccggtcacaaccagccgggagacaaccgacagccgtacatagcggaatgtgatataatagatgaggctgcacagaatcagtgtatgcagataccagtaaggccccatcggatggaggaatatcttgtcgagcaatacggtaggagtaatggcatctacactttcgcgtacgggcaggaaatgcgacatcaccgtataggccgcctccatgcaggcatacggaatgaaaatccatagaagcttgcggagaaagcttcgggcatccttccggttattggccagatagcccgaaataatcaggaaagcggacatgtggaacgtatagacgatttgtttcgcatacggatacttgtcgcctatatatacaaggtggaagataatcatcagggtgatgaagatgcatttcagataatctatctctttgacacggctttccatatagggtagttttctgcgtattgttattgatggcacaaatatatatacttccgtaaacttatttatattttgcaaagggattaagcttattttctcttttaccgattgcttttatgtatggaaaatgtatatttgtgcatgaatcattaacttaatgtaaaacagactatgataacaagccaattacttcacccggccagtattgtggtagtgggggcatccaacaatgtacacaaacccggaggggctatcctgaaaaatctgcttagcggcggatataccggtgagcttcgtgccgtgaatccgaaagagactgaagtgcagggtgttgctgcctttgcggatgtgaaggacattcccgatacggaccttgccatccttgccatacctgccgcgctttgtcccgatgcggtggagatgcttgctgcggagaagcaggtgaaggcgttcattatcctttctgccggttttggtgaggagacccatgagggtgctgtgctggaagatcgcatactggaaacggtgaaccggtatggagcctctctgataggccccaactgtatcggttttatgaactcgtggcatcacagtgtattcagccagcccatcccgcaactgcatccgcaaggggtggacctgatttccagctccggtgccacagcggtgttcatattggagagcgccgtgaccaagggattgcagttcaactctgtatggtctgtgggcaatgccaagcaaatcggcgtggaggatgtgttgcaatacatggacgaacacttcaatccggaagcggattccagaataaaacttctttatatagagagtatcggtgaccccgaccgtctgctgtttcatgcatcctcgctcatcaagaagggctgcaagattgcggccatcaaggcgggcagtagcgaaagcggtagccgggcggcgagttcgcatacgggggccattgccagtagcgattcggcggtagaggccttgttccgtaaggcgggtattgtgcgttgctattcgcgcgaggagctgacgaccgtaggttgtatcttcacactgccggaactgaaagggaaaaacttcgccatcattacccatgccggcggtccgggagtgatgctgaccgatgcattgagtaagggtggactgaatgttccgaaactggaaggaccggtggcggaggaacttaagggtaagcttttccccggtgcggctgtggggaatcccattgatattctggctacgggtacgccggaacatctgcgcctctgtctggagtattgtgaggagaagtttgacaatattgatgctgtaatggctattttcggcactccggggctggtgaccatgtttgaaatgtatgatgtgctgcacgagaagatgctgcattgcaagaagccgatttttccgattcttccttccatcaatacggcgggagccgaggttgccgctttcctggcaaagggccatgtgaactttgccgatgaggtgactctcggcacggcactttcgcggataatgaatgccccgcggcctgccaataatgaaatcgagctctttggagtggatgttccccgtatccgccggattatagattccattcctgcggacggttatatcgccccgcactatgtgcaggcattgctccgctctgcaggtattcctattgtggaggagtttgtttcggacaacaaggaagaagtgcttgcctttgcgcgtcgcacggggttcccggtggtggcaaaggtggtggggccggtgcataagtcggatgtgggcggtgttgtgctcaatatcaagagtgaacagcatttggcattggaattcgaccgtatgatgcagattcccgaagctagtgctatcatggtgcagccgatgttgaaagggacggaattgtttatcggtgccaaatatgaagagaagttcggacatgtggtactctgcggcctgggcggtatttttgtggaggtgctgaaggatatatcttccggtcttgcaccgttgtcctacgaggaggcttactccatgattcactcgttgcgtgcctataagattatcaaaggtacgcgtgggcagaagggagtgaatgaagataaatttgccgaaattattgtacggctttccaccttgctgcgctttgcaacggaaatcaaggagatggatatcaatccattgttggcgactgaaaagcaggtgatagcggtggatgcgcgcattcggatagaaaaataagggttagagattagggattagggattaaaggggctgactgttaatcgctcaccgctaatccctttttcatcctgcccagccctccctatccagatttctatatccgatagcttccgccaagtgtgccggctgtatcaattcgcagccttccaggtcggcgatggtgcgtgatactttcaatatacggtcgtaggcgcgggccgaaaggtttaggcggttcatggcagttttgagcatggcaagtcctttgtcatccggacgggcgtggcgagcaagcagtttactgttcatctgggcattacaatatatgccgggaatgtctgcataccttgcttcttgaatttgtcgggcacgtatcacacgctcgcgtatggtggcgctcgattcgccggggcgagaatctgccatctcttcaaaggggagtggggtgacttcaatttgcaggtcgatacggtcgagcaaaggtccggatatgcggttcaggtacttttgtacttgtccaggactgcatacacaagccttggtgggatgcgtgtaatacccgcatggacacggattcatagaggctaccagcataaaacttgccggatactctacattgcatcggatgcgtgacacggtaatcttcctatcttccagcggttggcgaagaacctccaatacgttgcggctgtactctggcagttcatcaagatataaaatgccgttatgtgccagactgatttcaccgggctgggggaaacttcctccaccggtcatcgctaccgtagaaatggtgtggtgagggtcgcggaacgggcgtttcgagatgagcccaccgtctttgcccaactttccggcaacagaatgaatcttggtcgtttccagactctctcccaaagagaggggaggaagtatagacggcagacgtttggcaagcatggacttaccgctgcccggcgaaccgatgagaagtatattgtggctgcccgaagcagctacctctaaggctcgtttcacattttcctgcccttttacttctgcaaagtcgaaatcaaagttgctctgctgggaatagaattcctcgcgggtgttgactaacgtaggggttaattcctgcgtgccattaaagaattctataacttccttgatgtttcccgctccgtacactttcagattgtttactactgccgcttcgtgggcattctgttgcggtacaatcataccctcaaaccccagttctctggccttgatggcaatggggagtgctcctttgataggttgcaggctgccgtcaaggcttagttcacccatcagcagatagcgttccagcttatcggactggataacttcgctggcggcaagtatgccgatggctaaaggtaaatcgtaagctgcaccttccttgcggatgtcagccggagccatgttgatgacaatattgctggtcggcatccggtagccgttgacctgcaaagcagatatgatacgttgatggctttctttgaccgcagagtccggcaaaccgactaaatagaacatacagcctctggaactgttgacttcaatggtgatgagggttgcgtcaataccttgaacagccgctccaaaaacttttatgagcacgtttttagtgattaggggttagtgatggcaggataggctaccgtcggttttgttttttgagtttcttttcactctctttcttctctttttccttttgctctatctcctccagtttctttttgatgtcttcctcactcatattcttcccttcaatttttccggaagggctaaggaacagattggcaggcaatgcttgtatggcgagctgtttgatgggcgctgtgttccatccggagaaatcacaactctgttcccacttcagggtatctcttttgattgcttcttcccattcctttctgtcgatatccaaggaaatgccccagagtgcgaatagcttgttcttttcttctttcttgtaaatccggcgcagggcagcgttggcttccatgctttgcgggtcccaagatgcccaaaaatgtatcaacagatatttgtccttaaagctagtacggctgatttgtgtgcctttggcattgggcaggttgacgtaagggatggttttcccgacggataccttctcttcttcttggataaggtcaagcagttcgtccacatatgggcggtctttcaggcctccggtcatgtgttctgtcatttctttgattaaggagaagtccggttgcggtttttgcacgaaatatttctccagcagatagatacttaccagtgaagaaggatggctgttgatgaaggcttctgctttttcttccaatgctttctccgagggagtactcaaacctttcaactctttctgaaaggcggtcagttcttcattgggaacattccccgtgatttccagtgaagtaagttcggcggcagaaccttttatctttatgttgtctcctttgtccaggtaaagcggatattccgtaccgtcactgaattgcaaccatgtagaggcaagtgtgtcggtggtgagggttgcagagaacttgtcatccttgacaagcagagtgtccatacggttatagaacttgtccgtaccatatatataaagggtatcattccccagccctttgatttcaccatttaggtagactgaatttgtatttttgctgccgcaggcagacaatataataagcagaaggtatgcaagatagattttcttcattccggttctttttctgatacttcgtcgcgaaaatacttctttttggtgtgaataaaaagaaatgcccgacatatttctatgccgggcacgttcttttcaatctaacctttattatttgatgatattcataaagtcagtgttagtgaagtatttggcgaattccaggtcagaagcagccttctttgccaaagccggttcttttgcaatggcattcttcagactgctggttaccatagatgtattgttggttcttgcgccaagtacagccatcaggtagtcagtataagcgtctggtctttcgatagcagccagtgtgttcttagccttgttgtagtccttagccaggatttgtgccaaagcagcgctgttagtcttagtgtcgccaaatgagctgacagccttgtcgtactgtccttgagcaacatacagattacccaatgcctcgttcagttccttagaaccggaagccttgctcagatagctttctgctgctgttctgtcgcccttggtcaaggcaatcagaccgagattcatgtttgcttcaggagcatccttgatggagagagctttcttgaagtagctttcagccttgtcaagatcaccagcctgataagccagtttacctaagttgttgtaagcacggaaatcgttcgggtagatttgagtagcttttgtgaagatggcttcttgcttggcagcatctttagtcaaggtggtggcatacagtaattcttcgatgttcagctgcttggcatcgctgtcggcgaggtttgcgatttcttcgtcagacttaccgatgatttcgtagttcaaagtcaggcgtgaacgacgcagttgcggcaggatttcgtcagccaaagtcttataaacagaagagatgttcttgatttcttgttctctttgttcaggatcctgatacatggaaagaacgcgaagaatcaattctttatcttggatgtttgatttggataccagttcctggaagccttcccagtcctgagccgtatacttggtgtctactgctgcatcgatttttgctttcttcaaatctctgttgatgattttagccgtgttgtcctggcggttctcagccagtgtagtattcaagcctacaccaccatcgggagaagcgtatgcggagatttcgatgttgctgattttcttgttttcagcttcgtctatgtttttcacttctttgccgaattctttggcagtcttcaattcgctggcgcgtacgttggcttgttgaatcaagaacatgatgttggcgtcatgcttttctttgatgatacgttggaaagcgtcgtcaccattggcggggttagcgctgcccaatgtttgttccagcatctcagaagtggagattacaccatcagctacttttacagcagggatagtgacagtctttttgcctactgtagccttgaattccagatacagttcggatttggccatttccggtacatagtcgaaagatgtcttcatagtgtagctgccgcccatcttgtaagagatagtctggtcgttaccttctactttttcgccctggaacacagccgattggcctttagcttcgccgccattccatttcagcacaggggtcacttctaccacagccttcttgttgaagtacttttcggggaattttccgttgattgtagcgggaactttaccacccacagcttccagaacttgaggagttacggtgaaataatctgatgacaattcacccatctttttgctgcacgatgtcattaatgcaacaaccattgccattaaaaacggcagatacaatttcttagtcattttaggtataaattaattgtttgtaattgaaatttgtctattccattttagtgtgctgtttgggcatggacacaacaacgcaaagatattaaatcctattacagtttgttaactcgcgcagcaattttatcataatttaatgaatttcccgctctttgcggtactttatattgcggggatgatgttctatgatttcactgcgcaatctgtgccggtcaatatgtgtgtaaatttctgttgtagcgatagattcgtgacccagcatactttgtatggcgcgcaggttggcgcctccttcaagcaggtgggtggcaaaggaatggcggaaggtgtgcggactgatgtttttggtgatgccggccttcttcgccagttccttgatgagatggaataccatgatgcgcgagatatttttgccccagcgtgccaggaatacatagtcctcgaagtccttcttgattttccagcctccattgcggtccacgaaccagttccttatctccttgatggcacgggacgatatgggtacaaggcgctgtttgctgcccttaccttctaccttgatgaagccttcgtcgaaatacaagtcggagattttcaggttgcacagttccgatacccgtaggccgcaactgtatagagtctcgaggatggcccggttgcgttgcccctcgtttgtgcctaggtcaatggcggagatgatgcggtctatctcttccactgtcagtacttctggaagcttgaatccgattttgggtccttccaacagttcgctggggtctccctccaggtagtcggccatgacgaggaaatggaagaatgacttgatgcccgacaagatgcgtgcctgcgagcggggatggatgccgatgtcgtgcagtccggaggcaaaatgctgcaagtcatccagggtagtgtcaaggatagcgataccctctccttccagaaagtgcagcagcttctgtaagtctgtttggtaagcatccactgtattgggtgagagtgctttttccagtttcagatactggtggtactttctgattatcagcgtttgtttctccttattcgtggatttttcttctgatttcatttcttttttctacctttgcttcgcgaaaataggctgcatttcagcaaattgcaaataaatttgcatctgctttcggtttgcactatctttgcaccgcaaaggtataaaaaattgtgttatgaggatacagattattaacggccccaatataaatctcttgggcaaacgtgaaccttccatttacggtagcgttacttttgaagactaccttgccgaactccgtaagaaatatgcggatgtacagattgactatttccagtccaacattgagggagagctgatagacaagattcagcaggtaggttttgatgtggacggcatcattttgaatgcgggtgcttacactcatacgtccatcgctctgcaagatgctatccgttcggtcacttctccggtgattgaggtgcatatctctaatgtacatgcccgcgaggcttttcgtcatgtgtccatgatttcctgcgcttgcaagggtgtcattctcggtttcgggctgaactcctaccgtctggccatggaggcattaaaagattattaaataaaataggtatatagattatgttattgaagcaaacgaagattgtcgcaacgatttctgaccagcgctgtgatgttgattttataaagcagttgttcgatgcaggtatgaatgttgtacgtatgaatactgcacatcttggccgtgaaggtgccgagaagttgattaacaatgtgcgttcggtttccaaccgcatcgctatcctgatggatacgaaaggaccggaggtccgcacgacggttctggctgagcccattcctttcaaggcgggcgaccgcgtgaaggtggtaggcaacccggagcaggagactacccgtgaatgtatctcggtatcctatccccatttcgtcaaagacttgaatgtggacggccatatccttattgatgacggtgacttggagttggttgttgtagagaagacccccgactacctgctctgcgaagtacagaatgaggctactctgggcagccgcaagagcgtcaacgttcccggcgtccgcatcaatctgccttctctgactgagaaggaccgcaccaatatcctttatgccattgagaagaacatagacttcattgcccactcctttgtgcgcaataagcaggatatactcgacatcaaggcgattcttgacgctcataacagcgatatccgtattgttgctaagattgagaaccaggaaggcgttgataatatcgatgaaatcctggaagtagccgacggtgtgatgatagctcgcggtgacctcggtattgaagttccgcaggaacgtattccgggcatccagcgtgtgctcatccgcaagtgtattcttgccaagaagccggtgattgttgccacacagatgcttcataccatgatttccaatccgcgtcccacccgtgcggaggtaacggacattgccaatgccatctattatcgtacggatgccttgatgttgagcggtgaaaccgcctatggaaagtatccggtagaagcggtgaagacgatgaccaagattgccgcccaagcggagaaagacaagctgtctgacaacgatatccgtattccgctggacgagaacagcaacgacgtgactgcgttcctggccaaacaagcggtaaaggctaccaccaaactgaaaatccgtgcaatcatcaccgacagttacagcggccgtactgcccgtaaccttgccgctttccgtggcaaatatccggtattggccatctgctacaaggaaaagaccatgcggcaccttgccctttcctacggtgtggaagctatctatatgcccgaacttgccaacgggcaggagtattactttgcagccttgcgccgcttgttgaaggaaggccgtttatgtcctacggacatggtgggctacctgagtagcggtaaggaaggcacacagacctctttccttgaaatcaatgtcgtagaagatgccttgaagcatgctgaagatagtgtgctgcctaacagtaacagatacttgtaggataagggattaaggataagggggtagggattagcggttaatgattaattaataattgtgcgcagaactaacccctaacccctaatcccttatccctaacctataatccattaacaaagtgacgattgacgaatacattttgcagcacattgatgatgagggcgattatctgaaagcgctctatcgcgacacgcatgtcaagttgctatatccccgcatggcttccggacatttgcaggggcgtatgctcaagatgtttgtccggatgattcgtccccggcaggtgctggagatagggacttatagcggatattccgcactttgcatagcagaaggactgccagagggcgggatgctgcatacgtttgaaatcaacgacgagcaggaggacttcacccgtccgtggctggagaattccgattacgcggataaaatcaggttctacatcggtgatgctttggagctggtaccgcaactggacctcactttcgaccttgcctttattgacggagataagcgtaaatacatagagtattatgaaatggtgctcgcccgcctttccggcggtggatatatcattgccgacaataccttgtgggatggccatgtgctggaagaacaaccccatcgcacagacctgcaaacaatcagtatcaaagccttcaatgatttggtggcgcgggatgcgcgtgtggagaaagtcattcttcccctgcgtgacggattgacgattatccgtaagaagtaactgtttttttatctttttctcagcagccgcttgctgaggtatctcaccggataccatacggacaagaagcctacagtgatgaccgttaagaataccagaataatatccgtggcatgtacacttaccggataagcgtccactacaaaacttccattgcctccccccaatgaaatcaacccgaaacgttgctgcagaaagcacagcaacaatcctaaaacgatgccggagagggcgccgaatacagaaatcatcctgccttcgaacaagaagatgcgcgctataagccggtcatcggcacccaggttgcgcagtgtctccacgtcctcccgtttgtccagtatcagcatggacagcgaaccgatgacattgaagcatgcgatacccagaatgaaggtgaggaagagataagagatgagtttctctatttccatgatgcggaaaacatcggcctgctgctcgtagcggttctgtacaatgaaccggtcgccgagaatgcctgctattttcttttgtacggagccgatgttggaaccgggtttcagtttcatctcgatggcagagacttccgtgtcataattaaacagacggcgggcaaagtcgagtgacgtcagtatgtagcgtgaatcgtatttttgctggttgacggcaaagatggcgccgggcgagaagagatactcccggttgaaagccgcagtggggttggctatgtttacccgtacgttccgtttgggggcatagacctgcaacgggtccacgaactgaatgccggtgcccaactcggatataagttccacacccagaaaaccatagtccaccaccgagtcgctcagtaggaactttcccgtcccatagagcaagctgtcgatggatgtaagctgttcgaaattgtcctccactcccttgatgacggccattgcctggcggtccttgtactgcaccatggcattctcttccagtgtttccgtccacacgtcaatctcggacagggcgtgtacttgccggatgcacgcttcgtgcgggtcgaaaaccttaccttcgcggacggtgattttcagttccgggtcgaaggctgtgaaaaagcctgccaccatgtcctgaaaaccgttgaacacggacaaggtgcataccaacgccaacgtagccaatgccaccccacacaccgaaataccggagatgatattaatggcattgtgtttcttcttggagaagaggtagcggcgggctataaagaagggaagggacattatttcagcagttcgtcaattcgttccagatagtccagtgagtcgtctacgaagaacttcagttcggggataatgcgtagttggtggcgtacgcgggtacccagttcaaagcgtatggacttcatgtttccgttgatgttcttgactatttcttcgcttttctccgaggggaatatactgagataagcgcgtgccacgctcatgtcggggctgatgcgtacggcactgacggaaatcagtatgccgggcatggacttggtttgcaacaagaagatatcactcagttccttctgcaggagacgggctattttattttgtctggtagtttccatactgttcatttttttatgctggggtgcagcttgttttcacgttagcaaagttactgaaatatattgttctgccgactgtttatagcttttttttcattcttttccctattgtagggttcattcttttccgttctgtcgatgagatatgccttttcgtagattctatttgttgttcttgttatgcttccctaactttgatgtcagttcggagaactgctgatgatgagtgaagaaggaagagaaccattccgttatagaagagactctctctaaatagcgttttttcatgtattattgacttgagccgtttttacccgggagggtagaaacggtttttttgcgcatctgaccgggctttcttgtctcttgcataggcttccgttgtgtgttacataggcttctgttgtgttttgcacggtggtttgtcttgagaagcctttgggtttatcatgtgcgcacggctgtggtacgccttttccacagtcgtgaagaagacgtgccacagctgtgaagaatatgcttcacagccgtggtttttcatcaatatataggggttgacagaacagacataagggaatgacagaacaaacatgaggggataacagaacggacataagcactcgacgcattccgtatcagggtatgaatagcggaatgcgtcgggtgcttatgggggaatgatatgatatttttttatgcctttacatacttccttttggctatcagcactgccacgatgatacctatcaccagcagtgccagtgctccgtaggcgatgccttccgtcacgtgcaggctggtggggtcaaagcgcatttcgatggtgtgctgtccggcaggaacatgcattgtgcgcaggatatagtcggcgcgtgccagttcggcaggctgtccgtcgatggttacgtgccagccgtccggataatagatttcggagaatacggcaataccgtcttgggcattgttcgtttcgtacgtcaggcggttaggtgtgtaacttgtcaggcggatgctggagaggctgtctttataactttccgtggcacctttcagcacatccttgaagcgggcatccactacggctgtctccgtaggtatgatgctgtccagggcgtcaatctcttcgttggcgttgttcacatactgcaccttgtttacaaaccatgcattgccgtaggcgtgcgggttgaggatgggaacggtttgtctttgctgtcctgcagggaagatgaagtatttggtgtttagcatgttcagtacgcggaacttattggcatccacgctgtccatctcacctccggcggtggcaatggccttgtaggccgcctgcatttcgggagagatgtgatgctctatcatttcctggtagcggcgcagcttggccgggtgataaccgccgacgcttttgtgccagtaggaggtgttgttgtcatcgaaggtgctggtggcaaagttcaatacacgatagtccaagctggtatcttgtagtatcagctcgtctgtatttgtcttggtgaaggtttccgtacggatggagtggggcacgaactgggcatcattcagatagcgcttgttgaccccccacatatctgccaggcagagtatggtgatacctgcaatggtcagcgagctgcgcagcttgccgcttgcatagagccagagcaggctgcagccgatgcctatgatgatgaagctacgcagggcgtcgctgctgacgagttcggcacgcatctctcccaagttggcaaggatgccggagagctcgttggcgggtatcatctgctggttgacggcattctgcagcatctgtgcctcttgggcgggcacgtagccggagccgatgctgcccggggcaacggcaagcagcagggcgatgcctgcagtgagcagcaggctgatgccgaggggcttcttttcttgttttaagatttccggctcttcgagcaggcgtttcagggcaaagatagccagcaaaggtatcgtgaactctgctatgacaaggatggaggacacggcgcggaacttgttgtacaacgggacgtaatcgatgaagaaatccgtcagcggcatgaagttcttgccccaggacaagacgatggagaagaaggtggctcctatcaatgcccacttcaacggtcctttcacgatgaagcatcccagtacgaacagaaacaagacgaatgctccgacgtagacgggacccgacgtcatgggctgggtaccgaaatattgtgtcagtgagccgtacagactactgtacatcgggtttgccttgctcatggcagtttcactctggctgagggcggcagatgctccgcctttgaagttgggcaccagcagagtcagtgtttcgtcgatgccgtagctccactgggtgatgtagtcgcggtccagcccgctactggtctgcttggcagcgtcgccggtctgcaccagttcgcttttgccgcgcatggtttctttgctgtaggcataggtgtgatagaggttggatacgttggcggctatgccgacgagggctgccacaatcagtacggcacttgccttgaagaactggggcaatgtcttggtacgccatgctttctcgaagtaggctcccacaaagaaaaggatgacgaagaagaagtaataggacatctgcacgtggttcgaggtgatttgcagggccacgaacaaggcggtgaggatgcctccccacagcagtttcccgcgataggcgagcacaatgcctgctatggtgggcggcacgtaggcaagggtgatgaacttccagatgtgtccggcagatatcaggatgaagaaataggacgagaatgcccacatgataccgcccagtccggccagccagaccggtatgccgaagacgcgcagcaggatgtagaagccgagcatcagcatgaatgtgaggcacacatagtcgggcaggaagagttggtaggctttctgtacccactgcagtgacttggtggagtcatacgaaggggctatctgatacatgggcataccgccgaacagcgagtttgtccaacggctgcgttcgcccgtctgttcgtaatactccttgacttcttgtcctgcccctgctcctgcagccgtgtcgtgctgaaagagaatacggttttctatatccgccgggaagaagtaggcgaaggaaaggaggacgaatgccaagatggcaataaggtcgggaagaagcttcttcatgagttataagttatgagttatcaattaatcaattgtggggcaaagatagtgcaaaccgaatacagaactttcatgcttgcgtgaaaaagttttgttgaggtgcagcctatcttcgcttttgtggcaaagatacataaatgcagattgttattgtcacgttatcggcagaatgttgtacctttgcctttccaaaaaaagattaaagtgctttaatggtaatatgcaagcttaaattattatagatatgacaatagggataatcagtgcaatggacagcgaacaccgccggttggtggagcgcttgcaggataagaatacgtcgggcgatggtagtttccgctatgtggaaggtacattgggcggtaaccatgtaatcttgacgcaatgcggcatcggtaaggtgagtgcagcggtaggagcttcggaactgatacggcgcttttctccggactgcatcgtcagcaccggtgtggcgggcggcattgatgcttgcctgaaggtgacggatgtagtggcaagccaacgtctggtgtatcacgacgtctggtgcggcgacggtaacgagtacggacaagtgcaaggttttcccgcctcttacgagggatgttcctctctgttgaaacatgccttgtcgctgaacgaagccggaatggaaagccgcatccacagcggacttgtctgtaccggcgaccagttcatcaccaaccgtacggagctggataccatcaagcaacgtttccccgacggtcttgccgttgatatggagtctgccgccattgcgcagacttgctatctgtacaatgttccttttctcagcttccgcatcatcagcgacacacccggagtagaggaccatgcttcgcagtatgccgatttctggggaaccatggcagagcgttcgttcctcacgatatggaccttcctctccacccttcccagcaatttataactcataacttataactcataactcatgaagaagattcccagttttacaattgaccacatccgcttgttgcgcggtatttacgtatcccgccaggatgaagtgaacggagaaacagtcactactttcgacatccgtatgaaagagcccaaccgtgagcctgccttgggacaaggtgctctgcatactatcgaacatcttgccgccacctacctgcgtaatgacccgcagtggcaggacaagattatctattggggccccatgggctgcctcaccggtaattatctgctgatgaaaggtgacttgaagccgcaggacatactggcgctgatgcaggacaccttccgctttgttgccgaatatgaaggtgaagtccccggtgccgctccgcaagattgcggcaactacctgctccacgaccttccgatggctaaatgggagtctgccaaatacctgcatgaggtattggaacagatgaaagaggagaatatgaaatatccggaaaaagaagaaaaataaggggttagggattaaggattagggatgggtttatacctatattaaagtctatgcgaccccaataatccctaacccttaatcccttatcctttattattacacaatctcaatcccctgctccttgcaaagctgtaatcccaggtctttcagcttgaatttctgtatcttgccacttcctgtcatggggaattctttgatgaagaagatatacttgggtatcttgtagcgggatattttgccgatgcagaagtctcgtacatccgattcgtgcatatccactccttcgtgcaggatgatgaaagcgcctacggcttcaccgtatttcttagagggaataccggctacctgcacgtcttttacgccttccagttgatagaggaactcttctatctcgcggggatagatattctcaccaccgcggataatcatgtccttgatgcgtcctgtgatgcggtaattgccgtcctcgtcctttattccaaggtctcccgagtgcaggaagccgttctcatcaatgacttcggctgtggcttccgggtttttgtagtaacccttcatggtgttgtatccgcggttgcacatttcaccttgtacgcctacgggacactcttctccggtttcggggtcgataacctttacttccgtatgttcaaagtcgtgtcctacggtattgcaacgtacatcgaacgggtcgtctatccgggtggcggtcattccgggagcagcttcggtcagcccgtaaacgctggttaccttcatgtacattttctcttccacctgcttcatcagctctaccgggcagagggaacctgccatgatacccgtacggaggctggacatgtcgaacatgtcgaacatcggatggttcagttcggcaatgaacatggtgggtacgccgtaaagtgccgtgcagcgctccttgtggatggaggcgagcactaccagtgggttgaagcgttccaccattacttctgtacagccgtgtgtcaggcagttcatggtggcaagtaccacgccaaagcagtggaacaatggtacgcagacgcagagcttgtcatcggcggtaaacttcatgtgctcaccggtaaggaaaccgttgttggcaatgttgtagtgggtaagcatgacgcctttcgggaatcccgtagtgccggaggtgtattgcatgttcactacatcgtggcaagtgacctgacttttgagctcattcaggcgactgtcttctatattgtcgcccaagagaagtatttcggccgtgttgtacatgccccggtgcttctcctgccccacgtagatgacgtttttcatataagggaaacgttcgcttttcaagtgtccgcgttggcaagtcttcagttccggaagcatggtataggtcatctgcacaaagtcactgtccttttcgccattgacgatgcagagggtatgcatgtcggagttctggcagagatattccagctcggactgtttgtagttggtgtttaccgttacgtagacggcacctatcttggcgcaagcgtataatagagtcagccagtcgggtacgttagctgcccagatacctacgtgtgttccccgttccacgccgatggcgataagtcctttggccatgtcgtccacccggcggttgaactggctccaggtgaagcgcaggttgcggtcagagtaaacgatatattctttgtctggtgttgtttcggcccaatgttccaaccattggccgagggtgcgttcgtataacatgatgtggaagttgaaagtggaaaggtgaaaatagaaagtatttatcattttccattttcacctttccattaatttaaataggtgtataaactactgcaagtatcttggctgcctgcccttcataggcgtgtacgtggtgcggaacgatggaatcgtaatagatgctgtcaccttcttcgagcaggtaggtatttttgccgtaactgatttccatggtcccttccatcaccatgatgaattcttcgccttcgtgtgaggagagtacaaagtcactgtcgtccgtagcggccacatcaatgataaacggctccatatggcggtcggctttggatttggagagtgaatgatactccatatgcttgcggctgtggatggcattgttggagaaactgatactgttctgcgactcgtccttacggcagaccacgggaccgttctcatcctggtcgtcaagaaaagttcccaaacgtacacccagcacacgagctatcttgatgaggggagccagtgacgggaggtcgatgttgttttctatacgttcaatctgttcgatagcaagtcccgaacgctgtgccagttcttccatactgatggattggctttcacggagtgattttattttttctcctacgattttgctggtatccataatgatagtattttctgtctaaaggttataatttatagctgttaaaccgcaaaaataagagaaacttttacttgatgcaacattctgagggaaaatattgctgaaatatctccggtggtcggcttatttgtataatattcttctgttctgtttctctttcttccccaaagttctgtttatagccgcttcaagtcttgttccgatacgtgctttcctttgtacgctttgcctgctgcattgaaacgatagcttaggttcagggagaagctgcgtgagtccgggtttgcctttttcgtataggtcagccggggaccgaacagcatgaaggagccataccgggaattccacaggtcattggcttgcagtccgagcgtcagccttttgttgaagaatgttttgcggatgccggcgtctatgccccaataggaacgttgcagcatggcgccgaagttgccttcgctctggtagtcggcatcaagggagagaatccactcgtccggaagctggagactgttttgcagaaagaggtaaatgctgccgcgattcatattcttgctactgccttgattggtgactttgaagaacggttgggcgaagtagatgccgagctccggtttccagatgccgacggtgggtgacagatgggcagaggcggtgagatactgcatccgtttgaaatttccggtagtgaagatgacaacatccggattgtcctcgtattctttggtcatgaaggcaatggcattgcggcggtattggtagttgagtccgaattgtacccatttgtaaagggccgtgaactgcaggtcgtggttggtttcgggggtgagcagcgggtttccaccttcgtagatgaaacggttgttataactcagtgtgctacgtagctggaagaagctggggcggttgcttttggctgtatagctgagattggcttgggctttgccgagaggaaagtctaccgataggttggggcaccagtcattgtaagtacgactttgaccggacacgtacttttcctgctcccaatagtcggagacggcatgctcgaagcgcagtcctgcaagaaggctgatttttcctaatgtcagtgagtattcggcaaagacggcggacttgctttcgtcgattcgactgtctgtatcgggaagtatgtgctgccggttcaggaaattgtcatttcgccggatgaaggtgtaatcggcaccggtcttcagttcacctttccaaaggggatgggccagaatcaacttggcggcataaaggcggttgtcggcgtggttgaaagagctgatgtcgcgattgccttcggtctggctttcttcttgagcctcctggtgattataacttttgccgtataccaggtcggcgttgaagtttatgtggagttgctttatgctgccctgatagtaggcattcagctggtgccggttggtttgctgcaagttttgggaggaatgtatggtgtgatcggccaactcttcatttgcccggacggtatatgccgaatggtcactgctgtgataatcgggggtacgatgaaactcataggaggcaccgaggctgtgttgggggttgaagtcgtaactggcgcttgcttttcctccggcaagtagtcccttattatataagtgaacccggttatttacatcccattgtatttcggacggtatctggtagcgaacctcctggtggcgttttctgttttcataattggtgtacagcatgcccagcagggacagtcctttcttctgataattcagattgacttgtccgtaatggctgctgcgtctccgttgggtgattcctgcacggaaattaccgccaaaactgtctcttttgttacgtacggtgcgtatgcgtacaacggctttaacggtagcatcgtactctgcacccgggttggtgataagctccactttttcaatatcggcggcagagaggcgttgcagctcggagttgtcttgcagaaggcggttgtctatatagatgaccggtgtccctttgccaaaaacggtatacccctcatcagaggagcgcagtccggggatatgtttcaatacgtcgttggcatcattcaaggatgcaagcagggtttgccgtacgcttgtctccaactttccgccctttagtcggaaaacggggcgggcggcggtgatgacggtttccgcaagtagcacggcatcggtttgcaatatccagttgtgggtactcccggtggggcaaggctggcaaagggctttgtaaccgatggaagaaacttgtagtagatagtttccgggagcgggagggagaagttcaaaactaccgtcgcttcggctacacgttccttgtatgaaggtggaatcttcggaaaggagggcgatgttggcaaactctatcggttgcttttcctctgtgagaattttacctcggatggagggtgttgccgggctggtttgtgcttttgttgtcgtgacgctcattaggagcagggcaagaatacatattatctgtttcatgttccggttgttgtttgatttcgggacacgaaggtatccgctttctgccgggatggaagaaacaaaaagcggatagttgtctgacatttgcctgacaatagactgacaatgccttcttttgtccttttaaagggggaagatgattacttttctgtatccatctctccggtgaacgagatggactgtttgttcatgggttgcacatggatactggtagaaccatcgggaaagatggtgaggcggtactcataattgtcttcatcactacgggtcttgaagtctatttggattttgccttttttgagtgctctggttgtgtatccggtgatggatgcattgaaattcaggctcttgcctcctccatacggagcattgtaggccactccaaagtaaggcaggtaagagaaaacggagtcgtttctaatttccagtgtatagttggtggtcaggttacggctaccgcctctcatcggttgcatccgatctacgttgattttgtattgtttagcagcaatagcttcttttacagcacgttcagtgcgcgctttcttttcgttacggttttgggcggttgtcggcattgcgacagttaggcagattagccctaataggataagtttgttagtcttcatgattctataatgtttaggtttttatttccagtccgtaggcgcggccacgatctgttgttattctgaggttgctgttgtcctcgacaatgggcttcagacgccgtatcaatgtgtaaagcgtttcgtctgcattgtcttttcccggccatagcgattggcagatgtcggatttgaaaagtaggtgtgaggaagaaaggtagaacatctccatcagtgtgtactgcatgggggtgagttttagcttttcctgctgttcgttatagaagcaggcttcctggagggaaagcgaaaggttgccgaaggtaatgaagttttcttgttgctgcccgttactggcattagtctttgtgtgccggtggaaatagaaaaaggtgaatcctccccacagcagggcggccaatagcaatgttgccggaattgtctgcttggataagctgaacagcatggcagctgagcagcgggcatatccccggaaagaaagtgtcagcccagatgcatcggctgtggtggagagccatactaatgtgtcgctggcaagacatccggcaggaatctcattgaatacggtggcgggagcattctttttcagtatatgtagcgaaagggtagaaacatctttcaatccggtgatggacaatgcttcggtaaaggctctgtggaaaccgcttacggaaacgggagtgcccatcacttcttgcaacttggcataggtttggatggtatctgcattcaaccataatcccttgtgctgcaatactgtgcgttgcagcgcttgattcaggtcagagaccacacgttgttctgcctgcgaatagctgcgataaccgaagccgaatgatagcagtatcaatagaaaagtgattgctatcgaaagatttgctgctgatacttttcttttcatggatacaaaattaggtataaatcggattataaacaaaaaaggaagtttccttttggaaaacttccttttttgatggttttgccgcaagtagattacttacgcaagccgagttctttgacgatagcacgatatctggtgatgtcgcggtccttcagataagtcagcaacgcacggcgtttacctaccaacatagtcaaagctctttctgtactataatcctttctgttgagcttaaggtgctcagtcagacgagcaatacggtaggaaaacaaagctatctgagcctcagctgagccagtatcagtgttagactttccgtatttgccgaagatttcttgctttttagcagcgtctaaatacataatgtttaattaaaagttattataaatattccctttcggggctgcaaagatagggataaacttttatatcacaatgatattcagcaaaaaaatcatatctatactgcatatctaatccaaaatcactaactttgtcgcttgaaaataataggtattatatgcaaaagattagaaacattgcaattattgcccatgtggaccatgggaaaacgacgctcgttgacaagatgcttttggccggaaaccttttccgcagcaaccagagcacaggtgaattaatgttggataacaatgacctggagcgtgaacgaggtataacgattctctcaaagaacgtttctatcaactacaaagacaccaagattaacattattgatactccgggacacagtgacttcggaggtgaagtggaacgtgtattgaatatggcggatggatgcattctgcttgtggatgctttcgaaggtcctatgccgcagacacggtttgtattgcagaaagctctgcagattggtctgaaacctatcgttgttgtgaataaggtggataagccaaattgccgtcccgaagaagtgtacgagatggtgttcgacttgatgttcagcctgaatgcaaccgaggaccagctggatttccccgttatctacggttctgccaagaataattggatgagtaccgactggcagcagccgactgataacatttatccgcttctggactgtatcttggagaatattcctgcccccgaacagttggagggtacaccgcaaatgctggttacttcgctggattattcttcgtataccgggcgtattgctgtgggccgcgtacaccgtggcatattgaaagaaggcatgaatgtgtctttggcaaagcgtgacgggagtatcgtgaaatcaaaaatcaaggaattgcatacattcgaaggtatgggccgtgtaaaggtgcaggaagtgtcttccggtgacatctgtgcgttggtaggtatcgaaggattcgaaatcggagatacggtctgcgattacgaaaatccggaagcgttgccgcctattgccattgatgaacctacgatgagtatgctcttcaccattaatgactctccgttcttcggtaaggaaggtaagtttgttacttcccgccacatccacgaccgtttgatgaaggagttggataagaatcttgcacttcgcgtgcgcaagagcgaggaagacggcaagtggattgtttccggccgtggcgtgcttcatctttccgtactgattgagaccatgcgtcgtgaagggtatgagttgcaggtagggcaaccgcaggtaatcttcaaggagattgacggcgtgaaatgcgaacctattgaagagcttaccatcaatgttcccgaagaatatgccagcaagatgattgatatggtgacccgtcgtaaaggtgaaatggtgaagatggaaagtgccggcgaacgtgtaaatcttgagttcgacatgccgtcgcgcggtatcatcggtctgcgtaccaatgtgttgaccgcttctgccggcgaggctatcatggcacaccgttttaaggaatatcaaccgtataagggtgagattgaacggcgtaccaacggttctatgattgccatggagtccggtacggcttttgcctatgccattgacaagttgcaggaccgcggcaaattcttcattttcccgcaggaagaggtttatgcaggccaagtagtgggcgagcattcccatgacaacgacttggtgattaatgtaacgaagtccaagaagcttaccaatatgcgtgccagtggttcggatgacaaggcacgtctgattcctcccgtacagttctctcttgaggaggcactggagtacatcaaggaggatgaatatgtggaagttactcctaaatcaatgcgtatgcgtaaggttatcctcgatgagcttgagcgtaaacgcgcaaacaagaactgataaacagaagagttttagttgttatatatgaaaggagtgccctgccgaaaggtgaggcactcctttttattgtcgtcattcaaacgaaagtcaatcgatgaattttacctttgccgcattacggggtttggcagcgggcgtttcgtccggatagccgaaagcgatacagtaaagtagctgatagccttccggaatatccagtttcttcaggtattcggcagcagccggagtagaggtcatgaagcgcgtgggaccgcccaagcagcaagaaccgattcccatggaccaggctgatagaatcatattctcacccaacagtccacagtcaatctgtgaaaggtcataagacgggtcattggcaataaatactactgtagaagcgttgcggaacatgttcttgaatttcgggtcttcggcggctttgggattttccttcttgtagatttccgtaattccgttgatgaaatccgggttatccactacacgcacttcccacgattgcttgttctgtccgttgggtgcattgataccgcaatccaggataatctgcatggtgtcgcgattcacggcttgcggtttgtactggcggatgctgcggcgtgacatgatggtttcaatcaccgtattctctttgctttcatttgcattggcaacttgggtctctttctggacctgggcaccgcaactgcagagcagcaacaaacttgcgcctgccaacatcaatctgatacttttcatattgctttatttgaataatggtttctgcaaaactactaaaactttcggattatcaatgagatagagatattaaaaaagaaaaaaggcatctcccggaggagataccttttccatatgtttctaactttattgtcagattagagcttcggaccagcagcaaccaaagccttaccagcttcgttgccagtgaacttagcgaagttcttgatgaagcggccagccaggtcttttgctttttcttcccattggcaagcgcattcgtaagtatcgcgaggatcaagaatcttcggatctacattaggcaattcagtaggaaccacgaagtcgaagaaaggaataaccttcgtcggagccttgtcgatagaaccgtcgaggatagcgtcgatgataccacgagtatctttgatagagatacgtttgccgctaccgttccaaccagtgttaaccaagtatgccttagcaccaaccttgttcatcttcttaaccaattcttctgcatatttagtaggatgcaggctcaggaaagcagcaccgaagcaagcagagaatgtcggagtcggttcagtgataccacgttctgtaccagccaacttagcagtaaagccagacaagaagtagtactgagcttgttcagggttcaagatagataccggaggtaatacaccgaatgcgtcagcagacaagaagattacctggtgagcgtgaggacccttagaaaccggtttaacaatgttattgatgtggtagataggataagaaacacgagtgttttctgttacgctcttgtcagcgaagtcaatcttaccgtcagcagctactgtaacattctccaacagagcgtcacgcttgatggcagcgtagatatcgggttcgctttctttatccaagttaataaccttagcgtagcaaccaccttcgtagttgaatacaccttcgtcatcccatccgtgttcatcgtcaccgatcaacagacgtttcgggtcagttgacaaggtagtcttaccagtaccggacagaccgaagaagatagcagagtcagtaccttccatgttagtgttggcagagcagtgcatagaagcgataccacgcaacgggttcttgtagttcatgatagagaacatacccttcttcatttcaccaccgtaccaagtgttcaagataacctgttcgttggtcttcaagttgaatacagtagctgtttcagagttcagacccagttccttgtagttgtcaacttttgccttagaagcgttgaatgatacgaaatcgggttctccgtagttagccagttcttcagcagtcgggcggatgaacatgttagttacgaagtgagcctgccatgccacttccatgatgaaacgtactttcatacgagtagcggggttggcgccacagaaagtatcaacaacgaacagacgcttgccgctcaattcctttacagccttagcctttaggtcagcccaagcttcttcagagcaaggtttgttgtcgtttttgtattcttcagaagtccaccatacagaatccttgctggcttcattcattacgaagaatttatctttaggagaacgaccggtatagatacctgtcattacatttacagcacccagttcagttacctgacctttttcaaaaccttccaaacctggtttggtttcttctgcgaacagtacatcgtaagacgggttgtggataatttccttcacgtcttggataccgtacttgcttaaatctaaatttgccatttcttttaatgatttaaaatgttggtatttggtttataatctctttccttaatctcttttacctttgatttacaaggaaaaacgggtgtagaaaagctctttttttcctgcttttcagcaggtcccttgtttttcgcctacaaaagtaatactttctttttaaagaaaagctctattagagaaatttttctctaataggaaatcttttataaaaccataacaatatctgctaactgaatgttgcaaattgggtgaaattcgtttactttgcacatcaaaacattctataattatgaaggttatcaactttgccgagacaaattctgtcttgaaccaatacgtggcagaaattcgtgatgtagcagtccagggcgaccgtatgcgtttccgccgtaatattgaacgcattggagagataatggcgtatgaaatgagtaaggaactgacgtattctgtcaagcaggtacagactcccttgggagtggcgtcggtcagcacacccgatgacgaggtggtgattgccactgttttccgtgctgggctgcccttgcatactgggtttttgaatatgttcgaccatgccgggaatgcttttgtttccgcttaccgttattataaggataaggaatgccgcacggtggatgtacacatcgaatacatcgctactccggatttgtccaagaagacattattgattgtagacccgatgcttgccacgggagaaagtatggaattggcctggaaggccttcattacgaaggggatgccagccaagttgcagatagcttgtgtcatagccagccagcagggcgtagagcatctggaaaagctgttccctggagatgaagtgaccttgtggtgtgcagcaatcgacccggagatgaacgagcattcctatatcgttcccgggctgggagatgccggagatttggcgttcggtgacaagatataaggttcatatatcttttccatcagccttttcccaagtgcgggcctataatgacccggttcataataattgtggatgtcttccgtgtattcgttgataccggtgaaatcaaatacattccgttttccgaagaagcgcttcagtgtctttacgtcggcagggcttatgttgacctgcaggtagtcgggactgataatgattttcacatcggtatcatgcttccggcaaatccactttatttcctgcaacaagctgacttgtttttccctgagcacttggggggcttcccggtatttcccgtctctataattcttcattttctctttggtgaattctcctttccggttttcccagtacttatctccctcttcctttatcatttcctccctgggattcagcacatcattggttaccgggtttcgggtggagccatagggatttatcacccctttcatgtaagggcgataggtgtggaacagcttgtagtccagataggggaggagaaagttcgggtagaagaaggcttggcagaattccttctggaacttgaagttgcttattcccgatatggcgggcggcagaatgttggaatgtccggtcaggcagcggtcgttgtgcaatgattccttgtcgataatcagcagcaggttcttgattgttgcacctgccttgtccagtgccttcagcttcaggcagacggcggcaaggctttcggcatttccgaataaccgtacggctcttccaccgtggaggtatttttcccattcatggcattgataagccatagtgcaggagtttcccatgatataggagtcgatggggatagtatcccggttgttcagatacatctgccaccccacgtgcccttcgtttagtacaaccggggtttggtcgtatcgttcatagttcttcaggaccatgaaagggtcgtccaggaaatagactgccagtagggctataaaagggataaaaaggataaatagctttttcatgaaacgtatggctgcgttccgttcgctgtttttcttcatcatgtgtctttattgtcaaaattgtaaatatatgaagctgtccgagttgaactgtcccagtgtgaagagtattatggcgagcagataatagatactccatcttacggctgccggctgtcgtccgaaggcttccagcaaatcatgcttggacatgaaatattcgtaaaccaatatcagtacgagtgcgcttcctgccacaatgctgttgtggtccggcattccgatgttcatttccttccagctgtaatgcacatcgaaggagaggtggctgatgtagtggaacgcttcggccatggagcccgctcggaagaatatcagagagacggcaaaaagcaggtaggtccttacgacggatagtgtggcatataagcggctccccaattgggctttcagtctgcggtgaaatgtcgtggtcttcatctcgtagaagatgatgacaccttgaattagtccgtagacagcaaagttccatccggcaccatgccagatacccagtcccgtgaaggtcagcgccagacttagaaatacgccccattgtccccatccacgcaggctcgaggacaacgggaggtacagatagtcgcgtacccagaatgaaagcgacatgtgccatcggcgccagaagtcggcagtggtctgcgcaatgaacggccggttgaagtttgggctgagcttgaatcccagcatgcgcgctcctcccaatgcgatgtcggtatatccggagaagtcggcatacagctctatcggatataggaggcatgccatcagcaattgcacgcctgaggctgtgtataccgacccgaagacaccgtctatgtatggggcgatggagtcggccagtatcagtttctttatcagtcccacgacaatcagtctcattccgtagaccatggatgcatagtccgtagctttgcaggacttcagttgggggagcatgtcacctgccctttctatgggaccggaaaggaacttcatgaagaagagcatgtatatcatgaagtcgggcaggctcttttccggttcttcttcttgccaatagatttctgtcaggtacgaaatggcctggaaagtatagaaagagattcccagcggaaaaaggatgtggcagtctgtaagccggtcggcataccggaatgccaaccagctcacgaccagaaaacacacacctgaaaaataagttcccttcatgctgctttcccgcttggtctgtcctatccatttgccaaggtagaaggtggtaagcgtgaggatgagggccgttatcagaaaagtgaggtggtagaagcctatgaagaggcagctggctgtcagtaaggtcgcttttctgaatcgtgaaggaagcgtatggtatagaatgaaagtacacgcaaacagtacgacgaagttcagggatatgaatgacatttcctagttggttttggttaaaatggcatggcagatgtctcccacgtttttgagttttacaatatctctgaaggtgaagcgtacattgaatttcttctctatcttgtttatcagttgcatgttggtcagtgaatcccatccttccacatcctgggcggtggtctcattgtcaagtacaatgttctctcttttcagtacctcccgaaagatgaggctcatttcattcaaaatagtctgtgtatccattgtcaagtttaaattagttcttgtattttctttctgtctgttttgctactggtgttcagcggaaactgttccaggcaatgcatatgcttgggaatcatgtagtagggaagcctgctatacagatattcctccatctgctgtttgtcgagctgtttcttctctacgacgagatgtagttcgcactgattgccgttgtcgtatttgggaatgacgactacacggcattcaccgttgaaaaagttttttgccacatgttcaatctcgctcagctcgatgcgaaatccttgtatctttatctgtgagtcttttcgtccgcaatagatgatgtcaccgtcggcatccatccggcagaggtctcccgtcttgtagtatacttttccattggcggtctctacgaggcattccccgtttttttcgggagcattccagtatccacccatcacttgattgccgctaatccatagttcgccggtttctccggtaggcagcgggcgaccgtcgttatccataattagggcatcgatgccttcgaaaggccttccgatagcggtcatgccgttgtgatgcttgcaggaggtgacgggtatccggtaggcagtgcagtagatggttccctctgtcggtccgtataggtttatgaaagaggcattggggacacattttctgaaagcatccaacagctccgcgtcagaagcctcggcagtaaccactagatatctaagtgcggggaggtgtatctccggaaaatagggacgtagcagctggagcagtgaaggggccacggcagcgaaggtcaggtcgtatttttccagagtttcaattacgttgatgtatttcacgccttccggagaaacggtgtatatgcaagcacccagcgtcagcggatatagaaaggatacgatggaaacgtcaaaagtgagttcgaacatctgcagcatccggtcgttctcgtccagttgccagccgaggcggtggtaggcggtatagaaagcattcaggttacggcgggagatgggtactcctttgggttcgcccgtgcttccggaggtaaagatgatgtaggcattttcctcttctgccgtatggaggatgtcttctgcggcatggaacgtggcggagttctctgcctgctctatttcggaggtacatatcagttccagattccgggtgtcgaggttcaagacatggatattctcggtatgcagcacgaggcgaatgcctgccgagtcggcaattctgtcgttcctatgtttggggtaggaaggatggaggatgacgtatgtctttccgcaaatcagtgcagatagtatggatgcgtatgtttccagtctgttttctgcgacgatgccgataattttgtcttctctgtccttgaatagggaggatattttctgtacgcaagttgccagctctccataagtgcaggccgtgtcttcgatgacgaatgccagtcggtcggcatatttgccgaaggctttcatgatgtcgccaatcaagtcatttggatactttttcatttagtccgttatgttatagttcagtttttgcggaagcgatgtttgtccgtcgttcattaaagacagtggtttcccgcaatctccctaccgggaaatccttaagatttctaaaaaaggagggatactgttcggaataaaagaaacagagggggcaaatacatactcaccacaggatagcacggattaacactgctaaaagctctttattatcagaactcctaaggcaatctgtgttaatccgtgttattctgtggtgagtatgatatactcttcgggcaaaatgggtttgcgaacaaagtccttattttgcccagaacagtttgtggtagtaagtgtcttcggctgacacctctttatagtagggattgtagttgacttccgtattcgggtatctccagcggttcggcacatttgtgatggtaccggccacttcggggaaggctaggccggacggatagccggtacgtcggatatcactccatgcctcacgactggctaggaaaccgaaatgcagccacttttgggtaatgatggcatccagcttgtctgtatatttcgtgctgttccatttggcagcggcgaaagaggcggtttcttcggcggtaggggcatcataccggcgtgcgttttcacccgtacttaccgaatcgtaatagtagtaaagcgtgatggactggctgacagcctttttgaactcttcttccgctttcgcttcattctttgccactccataccccatttcataggcttccgctttcaggaaatggatttcgggtgaggccattatcagcatgtcgaatttatcgttttcccaaaagaaacctttctgcgtgatttgtgagaaaccggtgttgctggtattgacttcgtcttgtgcctgcgagttgtaatattccgtcagctcatctgccacggtaaggtctgtgcccagataacggtgttcgtccaattgaccggtgttttggttggtaatcttcacgggattgaagttgagcaggatgcgcgggtcgtcttctcctttcacataaacgccgctcagtgggtcattgctggtcatatcatagttgccatggcccagcatgcggtcgatgatggcgcccgaagcaagtcggttagttacccagtcacccagtccgtggcctgcggtgaagttcagttgcccagacttctggttgacaatgagaatgttgttttcttgttcctctatcaacggataggctgacggattttccaggatttccttgatggcggtacggccttccgcctgcaagtctccttgcgcggctacgcgcatggcaaggcgcagtcgcaaggagtttgcatagcgttcccatttgtccatgtccccgttgttgataaagtcttgtgtattgaagttcctcggtgtggggatggagcggaaccgcggagcaatttctttgagctcatcaagaatggttttataaatatcctcggccttgtcataatgagcatacgatttacctacatcgttggtaagcggcagcgtacaagcttccgagaaaggcatatccccgaaaacgtccactgtggcggcaaagaaatcgtacaactgtactttggcggcaagatagaatgcctcgtcctgggcttgttctgccgcgctttcttcctcgtagagagattccagcttgcggaactgggccagtgccgaatacacattgtcccactgtccgtcaatagcgggtatatagccgggggtatacatatccgtagtgttggagtagccgaaggtttgtgcatacttgcccgtaaactgtgaatcgaatccgaagaaccggttgtattcgtaaacatcatagtcctttactttttggaagactcctaccatcagattactgatggtgacttgggttactttggaggggtcttcgtatttgctgtcgaagtcataatccgtacagcctgatgttgtcaagaggaatgctcccaatgaaacaagagataatatctttgtctttttcatactctttgttgttttttggatggttgttttgtcagaaacttgcacgaagtgaaacaccgaaactgcgggtagctgtggtagaacttcccacggtagcctggttggcccaggatgttccgacggacgactccgcatcgtagtttttcagtgctttgtagaagtagaagagattacgtccgaagaccgacacactcagccggcccagtcccagtttggagatcatcttttcgggaaattggtagccgatggtcaattcacgcagtttgacataagaattgtcgaataccgaatggcggtatgtcagctgttcggcctccgttccccaattataggtggtgttgtagtaatagcctgccggaatgatacgtgtgtttctttcgccagtggaggccactacacccggaagaatgatgccgtcgtggtagattatctctccgttggggccggcacccgtggaagggtctacttgtaccggaattccgctggaattgttgtcgcccggatagtaataggatagtccgccgtgttccgtatcacggtacttcagggattcgggtgtcagacccactgcggtggcatattggttcatttcgttgatgacatctcctccgatgcggaagtcgatactgaaatcgaggaatacattcttgtaggagaaagagttgaatagacctcctacgcctgccggattgatgttgccgactttctgcaattcagtttggttgaggtaaagacctttatcggaaacgaggtactcaccgttttcgttcacctggggaacctgtgcatagatgtcacccattggctggccttccacagcttgtatttttattccgctgcctccggagttgagtatttccagatagggcactccatcggccagtttcaccactttgttcttatatacaccatagttggctgtcaggtcccagcggaaatctctggtcagtatgggagtggcactgattgatatatcccagccgcggttggctacctcacccacattcatcaacacattctttacgcctgatgtggaaggttgcggcgtggagagtatctggtcctttacacggttgttgtagtaggatatatctatacccaaccggttgtttaaaaacttgctttccagacctatctcgtattcgtatttcttttccggacggatatctgcattcccccatgaagagggaatggtgttccaggtgaatccgttgtccgaaccttgctcgtagacgatattggcggtataggtttcaggagcatttcctacgataccgtatgagaggcgcagttttccatagttccaccatgacggcatgtggaaggcttgggtgaagagaaaactcagattagcggaaggatagaaaaaactctggtcttttagggtagacgatcgttcctggcgtccggtcagttcaaggaatagatagttgtcccatcccaggctcagtgtacccatatatccggttttcagtagttccatacgttgcagggtactgcttggcgtgtagcggctggcattgaggtcgaaccagttttccgtgacaagcccgccattggtggagaccctcatattgttcatattttcgtagcgtccggtccagcctacggtggcggcaatgtcgaagcggttgatattatagttgaagttcaacataacatctccatagacaatgtcgtaacggcggttgatggactggaagctaccgttggggtcgtatagggaattgggttgttcgctttcatatttcagtgtttgcttcacatctgtgatatcagttgaaacctgggcgcgcagactcagccagttggttatctgccaggtggggcgaatcataccgatgagccggttctctgtctcgtcgctatggtgatggtacatattccacagcatgttgttcactccggtggcgtaactggggtcgtaggcccatgattcctcaggagtcagcgtggcgtttcctccgacaaaggtattacggtatcccagactggtgacgtaactttgtttcagatagggaatgtccaggaaggtggagaacatgttgccgaaaccgctgtataggttgagcgaggtttgcgggcggtcttctacattctgtacgatgtagttaagggagtattccagtttcagcggtttcgccagttgatacgaaccggtcagcttgaagttgtgtttggtgaagcttccggtcagggcattgggaatctcgtccatgaatgtgtaggagaagcggttgctggtggtttccgtcccttgtgagatggcgagattgtaagtctgggtccagccggtgcgaaacaactctttccacgggttgtcggtcagtgcctggtaggggcgcatcttcccgtcccagtaaagtacctcgctgccgtcgtatttcgggccgaaggacaaggtggtggaacggaggcttttgtagctttgtccgtttagggttctctgatagaagcctcccgtctgtttctcataatcgctgtatgcggtgttgtaggttcccggcccgtatacggtctgtacttttggtagataagccggtaagtttgccatgacttgggcattgaagtccaccgtcagcttgccgcttttggcgcgcttgctagtgatgactaccgcaccgtttgcagcctccgagccgtagagagctgtggcggaagctcctttcagaatactgaggctctcgatgtcctctgggttgatgtctaccagaccattggaacggatttgtccgtcgttgccaaattcggcgaagtccgtgcttttacccgtgccgccgttgcggatgggtacaccgtccagaatgatgagtggctggttatttccagtgatggaagtcagtccgcgtacgttgatggagacagctccggcagaaccgccttgtgtctgtgtgatgcggactcccggtgctttaccgtacatggcagaggcaaagttgggtgctcctgcctttaccaattcgtctgcactgatggtactgatggcatagccgacacgtttcgtgtcttttttgatacccattgccgttactacgacttctttcagttgctgggtatcttcgctgagtgtaatcttcaggtcgccttgcttttttcgttttgccaggtttatctcccgagtagcatagcccatgtaagcgatagagagtgttgcatctgcaggaacggtcagtgtgaagttgccgtccacatcggtaatgacgccgttgttggtgcctttctgtatgacgctggcaccgataagcggttctcccgttacatctcttacaatgcctgtaatggttcggttctcttgtgcaaaggctgttccggtgaaaagaaatgttaataaccaacttgcaataatcaaacttttttggaagtgcgacgctgaatgtggaatgtcacaccgttttctcatcctgattttcatactactgaaaaataattgatttatcttattataaatgttacgtcctttcggcagatattttagcaagaggtatgccaaacgaaaggcagactatccttttaaggatgaataatgttgataatcaattgcttatttcctatcgggaaaaagggaagttcgggtgtttgtggtgtggagatgtggaaaaaatccacagtaggtattccacaatttccctctcttcccttgaagtcttgttgtcgacccttattggtagccttgttcatcggaggtatgctctatcactacaataaaatctggtgcagttgcagtggttgcattttttttcagggtgggagtgtttttgacctttatccgggaaggattactcgaacgaaagagctatcagcctgcggtttgtgagattgatattaagccagtataaatcagagaatcactttcaaaatgtgactactatggttactgtggcaaatatagttattcttgatggaagaactgcatgtttggcgtaataagtatctatgtttgggagagaaaggatagggaggtgctcttacttttaggaaattaatatcatgtttgcaccttatttgtttcgtgcaaacatgatattaataaatcttagtggtttattttacttcccacgtatcattcgtcatcaataactcctcgaagttgtgatacttcttcttggcagacacctcttcgatttgttcatgaacagcatcgtcgtaagtaggagcttccacatcgcggataacaccgagtgcaatcgggaagtcgggaccttccatcagggcaagcttcagttgcagggtgttgtccatgcagtgggcatcgtggatgaggatatccttctctgtaatgccgttctcaccgagtttcacgacttttagaccaaagccttcctgcatcagtccgtattcgttgttctcgccgaagagcatcggttcgccgtgtttcaagtagatggcattcttggcgcggtcttcctttttggctacggagtcatgcgtaccgttattgaagataacgcagttttgcagaatctcgcaaacggaagcccctttgtgagccatggctgccttcaatatttccactgtccccggagcatcggtagctaccgcgcgggcaaagaaacggccgcgggcaccgaagcaaagctctgccgggtggaatggatcttctaccgtaccatagggagacgacttgctgacgaaaccacgtggagaggtcggagaatattgacctttggtcagaccgtagatgcggttgttcagcagaatcatgttcaggtcgatgttacggcgtacggcgtggatgaagtgattaccgccgatggccagaccgtcaccgtcgccggagatttgccataccgtcaggttgggattggcaaccttggcacctgtagagatggcagcagcacgtccgtggatggtctgcatcgcatacgtattcatgtaatagggcagacggctggagcagccgatacctgagatgacggcattctcccaaggagctttgccgatttctgccattgctttgtgcagtgaagccagaaagaagtggtcaccacaacccggacaccaacggggttgtccttttttatagtcttttgctgtatattcgcacataatcttttttaattgatagttgataattgatagttgataattggtggctggtcattgataatccgcatattacgcatggttattatcaattgtcaactgtcaattatcaattaatttattgaacgctgcgaccagctcggcaacgacgaacggttgtcctttgacttcgttgaactggtacggggtgaagttgtctatcttcatacgtagataacctgcaaattgtccgagattctgttcggcaactaccaccttcttgtacttcttcagaacggtttccgtgttcttggggagcggattcagataagtgaagtgggcgagggcaaccttcttgcctgccttgttcatctcttccatggccgaatacaagtggccgtatgtaccaccgaaaccgacaatcagcaaatcggcatcatctgcacagccttgcacttctacatcaggtacggggattttggcaaccttctcggcacgcaggtggcacatcaagtcatggttttcgggatcggtggagatggcaccggtattgctgtctttctccagaccgccgaggatgtgcatatagccttcttgtccggggatggcccaatagcggacacctgtttcgggattgcgtttgtacggagtatagttgtccttcatttcggaagtcacgtagggaggggtgatggcgggatagtctgccagtttgggcagcttccaggcgccggagccattggcaacaaagccgtcggtcagcaatacgaccggggtcatgtgctccagtgcaattttgcttgccatgtaggctgcgtcgaaacagcttgtgggtgaagaggcggcgatgacgggcattgggctttcaccgttgcggccgaacaatgcctgtaacaagtctgtctgctctgacttggtgggcagaccggtagaaggaccgccacgttgcacgtcgagcacaaccagcggaagttctgtaatgactgccaggttcatagcttccgatttcaggcagacaccgggaccggaagtggaggtcacagccagcgcacctgcaaaagcggcgccgatagaagtggcgcaaccggaaatctcgtcttcgcattgcacggtcatcacgcccagagacttgtgcttggagagttcgtgcagtacatcggttgccggagtaatgggataggagccgaggaacagcttcaagccagccttttcagctgcggcgatgaaaccgtaagcagttgctttgttccccgtgatatccatgtatctgccgggaacggtagtcttactttcaatcttatatgtatgggctacggaagcatgggtgttgtgtccgtagtcatatcctgcatggatgaccttgatatttgcttcggctatttcgggctttttggcgaatttttcgcggataaagtcttcggctatcttcaaatcacggttgaacagccagcataccaggcctactgcaaacatattgcggcatttcagcatggccttgttgtccattccggtatcggcaaggcagtctttcaccatcttcgagatgggagcggcgatgacatcctgcttgatgcccatctcctctatcggattgtcggtcttgaaagccgccttttccaggtctgatttttggaaagcgtctgtatcgataatgatacaagcagtggatttagcaaacttatattgggttttcagtgcggcggcgttcattgctaccaatacgtcgcatttgtcacccggggtatagactttctcagcaccgatatgtacctggaaaccggaaacgccggtaagtgagccttgcggggcgcggatgtctgccggatagtcggggaatgtactgatgtcattgcccacggtagccgaaactgttgaaaagatgttgccggcgagttgcataccatcgccggagtctccggagaagcggactaccacttgctccagttctttgaccatcatgtcgtttgccataacttacgaattactatagattatttgaggattactattccgtttacatggacggcaaatttcggaaagttaatcggattaacaaaacttttttcggaaaatcggcagaatacattatctttgcatccgcaatcagcctgcatcgtgcaggaatagcgtagaagttctactgatattctacatattccgctgattatcagttgaggctctgtagttcaacggatagaacaagaatttcctaaattttagataggggttcgattcccctcggagctacttttcaagcccgtccccattaattaagaggacgggctttttgctgcctgctgaattcagcccgcaccgctacacagagttttttttctcattttatctgccatctgcaaggatttggtacttgcttcgctgtaaaccaatgtgttgtgggcttgcagataccccttgcagataccttgcagataaagtatctgcaagcccctaaatcgggtataaggccatccacggtgcacagtgcattcatgttctaaatagggataatccattagttcacagtgatgaacaatttgttcacatgctatagaacaaagtgttcatactgtataaaacaaagtgttcaccctaatgaaacaaagtgtttaccccaatggaacaaagtgtttcacgcgtcgaaacaaactgttctatgtggtgaaacgaactgttctatgtgtcgagacaagcggttttctacgttgaaactgaaaggattcacgttgaagtttgtcttttcctgtcttttcctgatttcactagacactttttttctttataaacgtaatcagtagacggttctttcatttgtatgctgatacagtagtcacttcttccgaagccatactgacagcatagacacaacgacaaaaagagccataccaagaagttcccttctcgatatggctctgtaaaaaactaatccctatatatacaagtatgaatttgtatttgttcggggtgtttcctggagattaatgtcctcccaggtaagcttcgttctggtcgcaggccggattcttgatcagctcgtctgccgggatgggcatatccatcttgttgatgttgaagtcgaagtcgcggtaagtccggaactcgaatatggcttcgaaacccttcaagtagccgaagcctttcgggtagttatgctcgatgtggtcttccagatagcctgacttctgcatgtctccacgcaggcaccattctgcgttgaactctttacggcgttcctcgttgactgccactttccacaagtcggaagtaaatcctttctcggttttcagctgtgcgtagtagttctgtgcgtctactactgtcacgggtgtctcgttgaaaggaatggggtatccttcggtagccacatacttgccatagccattgtctccgtacacacttgccagatttctgaagtaactgttgaatttggcggtgagttcactgctcttaccgacttccatgttgccgaatgcgcggttgcgcaggatgttgatttgtttccatccttcagcttcctctccggttctgaaacaacattccgcatagtccagcatcacgttggggaggcgcttcatataaatgtggtcgggaagccattggtctccggaccagtgtgttccgcgtccgttgcgccagtgcttggtagagtaaacggtcggtgccggttctgccggttcgcggtggaaggtgttgacccataccacttcttgtgcgaaaggattgaatcctatcgggcagtcggggtcatacttgatgtcgcagtccagggtttctacgtctttaccgttctcatctttctctatctttgtttttgcatatccttttcctatatatttggcattgtccgggcttgccagccaggcttcaggcttgaacgattgtttccaatgttctttgccgatttccttcaatttggattcaggtatggtggctgtcaccaaagaaccgtcacggcgtttgtcgccgttttcgtatgcgtcatagagttcccaggacacggcataggttccccatgcaccgttggcgggagcaccgaagtagaagcctacccaaccatgggcctcggaccacttggctccgtcccagccgccccactggtcgccttcgttgagcacggcctgccagatggcctctttgccccatacttcatcggcatcccatagcgtggtgaatgaaggattcagctcatacgtgccactgtccagaatttctttgagggctgtctttgccagtccgtaacattcattggctgtttcggggcaacgataagctttccacatgtaggcatcgcccagataagccagcgccatacctttcgtacaacgtccgtactgtccgtccatgggttcccagtcgagcagttcggcggcagccttcaagtcttcaatgatgaagtcccacatttccgcgtaggtttctgcacgggctttcgtcggtgtatttgtatagttctctccggtagaaagcatcggtacacggccgaatgtggtggctaaccagaagtactggtaagcgcggagggcacgtgcttcgccttccaacgatctttttacgtcgtcagacaccttgtcggcagttcccagtcccgacaggaagtcgttgcttcgtgtgatggcggcgtatgcctggttccatccggcggacaactcggtggtttgtgcattccatgactgggtcatgaacgctttgtcccatcccgtagcctgagagtccattgtcgggtgtgaaccggtgaacagatagggcttgaaggggtctccgttgtgcccggcggtgttgctcggcagcatcaggtcgtagcatccgttcagagctgctttggcattggcgtcgctttcgtacatggtactcatttccaagatggagtaatgtgtcacgttgaggaactcctcgttgtcgcaagaactgagaccggtcatcaccacagctcctgcaatcaaactgtataataatttgtttttcataatcaatgtaatgtttgatgtttattaaaattgcacattcacgccaagtgtataggtacgcggcatcgggtaacggccggtatccaaacctgtatagagcacactgccttgaccgcactcggggtcaccatacttgttgtaaccggaaagggttgccaagttctggatggagaggtaaacgcgggcgttctggatagaagccttctttaccaagttcttcggcagggtgtagcctatctggatgttggagatacgcaagaagtcgccgttcttcacccacatgtcagaggcacgcatgttgtagttggggtcgaggaaagacaagcgggaaagtgtaccgttgggattctcgggagaccatgcctgggcggcagcttccttcaggatgttgggcgcacagccgtcatcggaagagaacatgttggacagacgcatggcggaataagagaagatgtcttgtcccaatacgccgtagagatatacggagaagtcccagttcttgtagctggcgccgaggttcagaccgtagttcagggtcgggaaaccgtcgccgagaatatccatatcgtcctcgttgatgattccgtcaccgttcaagtccttgtacttgaagtcgcccgctttggttccgtccgtctggtagtagactttctctttttcccaatcttttcctgctgcaagggtggctgctttgttcattgcttcgacttctgcgtcggattggaaaacgccttctacacggaagccgtagaatgaacctaccgcatagccttccttgcagatggagtggttgccccagtgataaccggcagcggcacctacggcaccggtattggaaccgtcctcggtacctttaccggaggagtcggagttggtgttgtaagcaggttctcccatcttcttgattttgttcttcaaggtagaaccggtcagagtggcattgatgctccagtctttgttcaggcgcttgttgtaggcgaggctgaattcaaaacctttgttctcgatttcgccgtagttggtgtagacttgtgagaaaccggtagaaggacgtatctggcggtagagcagcaaatccttggacttgcggatgaagtagtccattgtcaggttcaagtcgccctgcaggaagctggcatcgataccgatgttcatctgctcgttggtttcccatttcaggttggtgtctaccaatccggcgaagtaaccggtggcgaatgtcatgccgttccacatgcccatgccttgtccgttgccgtagaaggagtattttacattttcaagtgacagacctgccacagaaaggtcggtggcgccaccggaattaccggtttgtccccagccaagacggagcttcaggttggaaaccacgtcctgattctgcatgaaagcttcttctgacacgcgccatgccaaagctgcggaagggaaggtaccccaacggttgccggcaccgaagttggaagaaccgtcgcgacggagcgtggcggtcaggatgtagcggttcagcaagctgtagcttgcacggccgaagtaggagatgccacggctttccagattcagggcgccgcttccgctcagtgtctcgggcttggtggtcaggcctacgttacggttgtccggactccagaatcctcttgaagaggcggaagtccactggccgtaatagcgtgaaacctcgttacccaacattacggtcaggtcgtgcacgtcgttcttccagctataagtcagcgtattctggatggagagtgtctgtccgtcattgttgcccaggccaaagctataatcgttgtcgttgctcggattgacgtaggcgtttgttcctttggtcacgtcgatggctgttccgttgtagtagtttacacgtttgatgccgccgctgaagttgttgtcggagttgccggtgtagtcgtatgaaaccagcgtcttccagctcagacccttcagcggagtgactgtcaggtaggcacttgccaaggcacggttggtacggttgcgcttgttcagctccatctgcttggcatacatattacctattgttgttccccagaaaccatcgttggtatctttaccgccgagcacttcaccatacgtgccgtcggggttgaccacgttcggagaaatgtacgaaccgacgggtacaccgtcatacgtggcatcgccacgagtcacgaagtccattgtcgggcacatgaaagcgaagtcacgcaaagaggaaaggttaccgaagttaccgatagagttgttcgagccgtgggcatcggtatggatatagcttacgtcagcgccgaattccaggtaattgttgactttggtcttcacgttggcgcgagccgtgatgcgttggtattgcgtgttgactaccataccgtcgttgcgcaggaaaccgatagaagcattgtactgtgtcttctccgtaccgccggaagtagagatgctgtagttctgcttccaggatgcacgggtcatcacgtcttgccagtcaatctgcttgcgtttgccgtcatattgctcgctccacacttcgttccaaaggcttgtgccgtcgttggcacgtgcttggcgcaggttggcggcatattggtctacattacaaacgtccagcttgttgggcagtgtctggagaccgaagtcggcagtgatgttgatggaagaatgtccttttgtcccgtgtttagtagtaatcatgactacaccgttggcacctgccgaaccatagatggcagttgcggaggcatccttcagcacttcgatggattcgatgtcggaaggattgatgaagttggcattggtacccacctgtatgccgtctactacatagagcgggtctgccttgccgttgatggtggcaacaccacggatacggacggcggcattggcatcgggagcaccgtcctgcatggttactatgacacccggggctgcaccttgcaagccttgtgcaatgttggtaggagtgcggcgcaacatgtcttctgcgtttacagaagctaccgaaccggcaatgtcgctcttcttcatcgtaccgtagcccacaactattacttcgtccaaagcttgtgcgtcttctttcaatatgatgtccaatgtggtcttgccggctacttggacagtctgagtgacatagccgataaaggagaaggtcaatttggcattggagggaacgctcatctgatattgaccgttgatgtctgtgatgatgccgttagtcgtacctacttgcaggacgtttacacccggcatgctttcgccgctggtatcttttacggtacctttcactgtaatgttctgggcacatacccaaacaggaatcatcagtaggaatgataataacccgatacttcttttaagattaatgtttttcatataaaaataggtaatagaaaaaataaattttactatagtggttaattaaggtataaatgctgtttttacaatttatacggaaggaatgaactttttttctatgtcttcataattgctttgatttaacaggttaatactttatattattctcgtttcatatcgaaagcaaaattatcaattagatattaataagtgtgaaattcacgctacctcttgtttactcgacgtaacatctatagatgaaaatgttacaaaaactgtttcgtacgttacatagcaccggcaatgtggtatttggtgggtgttgaatcttcacttgaccctattgaagttgacaacgcgatacttcaagttgacagacactggcatctaatctgtcagacacagcggaatgtccttcaccgtcaaccctcgaaatgaaaagaagtttcaccgggaaccccgatgaatagagcggttctgaaaaaggtgaaagctgtgacgagtttatttcaccacagaggacacagagtctcacagagttttttgagggaatcaaaatcggtagtatctgtcattagcttgtaaaaggagaaaactctgtgagactctgtgtcctccgtggtgaaagctaaattatcatttatgtaccaacttatttttttatgattacatagtccccttcgttgcattatgttcaatggagattttactgttcgtcaagtattgtgatagaatagtcgggagaaacgagggagtatagctttacatcattgggcaatttgttatccttggcgaattccttgttcatttcatatactttaccactgaatttgacctttaaaccctcgattgctatcttgagtagggcttcttctgcatccttggaggttgtacgtatatagaaacggctcttctcttcgtcttctatgtaggtcagtccgaggcttctatctttatgtaccactcccgcaatggagtttgcctccatcagatagttatcgactatagttatcgttctggggggaggaacgcgatcgccaacaacaagattatcatccttattgttacaagcagaattgaatatgaccgttcccatcatcatcagaaggaatacgcaaacagacggcaaattgtttcttttcatatgattcagttattgattgttgtgaaaataattagcaaaagtcaaattaattcatcgtaacttatttattagggttaaacaaatctataatgtattggagatgcaaccttggtttgatgagttgacgcttcatgtaacttctgtcttacatcgaaaacaaaattacgaattaaatgtcaatggttgtgatatttgcgttgttttttgtttgcttgatgttacatctatagatatgaatgttgcagaaactgtcttgtatgttacatggcatcagtaatataaagctgaacataagacgccggagacagagaaaatggagatgcctctattgaagagagtaggtgatatccgttcccttctctttccgggctgtccggctgatgtcgtatgcggaggtgttgacctttccggagatgaactcggggatattataggatttcatcaggaaggtgtaatggtctttctccttttgcggcagcaagaagggcttgtgtgctttcccttcttcgtctatataggcaatgaaggggcgggtatacagtccgtctgtgcgtcggctgctgaacaccacccagtggctgttgctgctccatgaatggtaactctccacgtcgttgctgttcagtgccgacaaggggcggatttggttggtgtgcaggtgggcgaggtataggtccgcatccttgtgccagatggaaaagttgccgtatgcggagagggtgaacatgaggaatttgccgtcgggcgatacgcgggggaaagagacgctttttcctgcccggcgtgcattgtaaagcgtgtctgccttgctgccgaacgaacgggtgtctgcatcaaagccgatggaacacaggctgtacttcacttggtcgtattttccgggtatgctcacgctgtccgcggaacagaaatagagcgttcttccatcgggcgagaaagtggggaatgtctcaaaggcagtggccgaggacagaagtggggagctgacaatctgcttccgtttcacgtcgtaaatcacgacatcggaggcataatccatgacttccacgcggttcgggtcggtggtatggaacatctgcttggtatcgttcaccgagaatgccacaaaattgccggagggatgccacgacgggtagaccaatgccgaaatggtctgcggtgttttcgtattcagtttctttatctgtccttcctctatgatgtaggtccctccgtagtcggaacggaggtggaacagcattttctccgggttctgcccgcagaaggaatggcagttcatgcagccgtagccggtcatcttgttggtgaggatggctgtttcctcatagttttccagacaacgttggtagatgcccatctcgttccaggtctcgtagcccggttctatcagccggtaggcgatgtaggggtctatcttctctttggcgatgtagaggtggaaaggggcgtattcttcccatttgtctcctctttgggcctgcaggcggacggtgatggtagatgcggcgtctacgagccttttccatttggagggactgatggctatctgcccgttgcgggttgtgacggtagtttcttcatcgcctgcccggtatatggcccggagacgggaggcatggcagctgtccggcagggagaagcatgggggagccatgttcgggggaagcgtgacttcggtataatcgggcgatatgggaggccggcaactggtatggcggtcgatatgtacgttttgtgagcaggctgccagcagcaggcagctgattagggttggcagatatgtcaggattctcgttttcatttctgttttcattttctatatttcaggaaataccataagttgtgggagtctttggagggttgtcggctgaattcctcgaagcgctccacggtagctgcctgtatgttgtatcgctccaatgtttcccggtctccggcggcaaagacaaccactccctcctgaaagcagacgggcagcacggacggcagcgccggtgtgccatagaatgtttcgagggtggccttgaaccgtggaatatccttggacagcagatatagtgagcctaagtactggatggtggtcttgtgcatggggttcttgaggacgatttgctttaaatcgtcgtccagccctttgatgcccgagaaacggttgtcggggaagaggcattttcgcttgctgcctaagatggaatcggtctctacagccgggtcgttccatagaaaacgtctgtgggctgtggcccagtctttatagaagagtgtactttcaagtatatcaagatacttctttgcagtgccataatgcccgtagataaggctggtctggaccagccgttgcagcatgcgtggagagaaattgcccatgccttcgttggcctcgaaggcatatcgttgtgaaaaggcgatgtgccccattgagaaatagatgtcgctgagcagtgcggacaggtagggcgttttgtttccgggcacgtaaatggtctgtatgtctatgcagggttgcatgaacagttggtcggccaacaggccttgttctgccagtgcgacgttgtgataattctggaaaagcaggttgttcatgggcatgttttcgcatttgtctgttatcttgtcccattggcagtggcgtgcgtagtggttcagttctttaaagacttcattgttcctgtcgatgtattgggggatgccgacaaaagtgaaagcgactgcacatgcgagttgggcagcgataagggttccttgcatccatcttcttttgaatctgaatgatttgcatagaccgcttgtgatgaaaacggccagtgtcagcccccaaggcagatagatgatggagcctgcttggagtcttagcgtgaagtagccgtcgggcagcaggacgtgttccaattcgccggaaagtcccatccgtaagcaagtttcagcggtcaggtacaccattagcggaagggatatgaaccagagtgccctcttcttgtgacagaacaattctatgatcagtatgaggcagctgtacagaaaggcgaccggtcctgccgttgcgaagagcaggaaggtgcttgcaagagaataggcaaaccgtccggtgaacttgtggaagaagaaccgcaggcggaggaaaagcagcatccacaggaaggctatggttccggtgtattggtagtttacgttgtagtgcaggaagaacaatgctgcaacggggaaaagggcgagtggtaatgtgagtttgctttttgtccagcggtgcaggatgtcggctgtcagcagtgcaatccacgtcagtagcagtgctgttatcaatattccggtcaggggtcggcagaagaattgggtcaggaagcttgaaaggagttgtacgcatccgccgggcagagccaaagaaccgctaaggtaggcggaattatagatgaaggtgtcccattgttccagataacagaagctgtagtagcccgtctggctcaatagaaaagcaagtaatgcaaatagggcagtccctgcaacgatgtatgggattcttctgctgtgaggtgccggtctgttcatggtatatagggttttgatgacaaaagtagatagaataaacgataatgtgggaaaatctcaggccgattattgggggcatacgggccgatgtaacatggataaaagtatttgtaacactgggcgtgccttgatgacggccgggatgggacaaaaaggaggccaagcctgaaaatgtaatgacgacgataaaacgtgatacatatgcataataattataagaagtgtatttgctacatttgtagcagagatattctaccatgaaaatctgatgagataatagattactaactgacaatttgcttatgaaaaacaaactcttgttatccgttgcaacctttctttgcctcatggcaggcagggcgcaagcacagaatcccataatccgcgatcagttttcggccgatcccacagcgagggtctttgatggaaagatatatttgtatccttctcacgacattcccagccctatagaacggctgaaagaatggttctgtatggccgattaccatgtgttctcttccgatgacttggcgcattgggaagaccacggggtcattgtcagccaggaacgcattccttgggccagaccggacgcctattccatgtgggcaccggactgtgtctgcaaggatggcaagtattatttctattttcctgccacccctcggggcgtggaaaagggatttgctgtaggagtggccgtatcggacaagccaagcggcccctttatgccgcagatgcgtcccatagaaggagtggaaggcattgacccttgtgtgctgacggacaaggacggacaaagttatatctactgggcaggccgcggcatgatgatggcaaagctgaaagataacatggtggaacttgcttcggaaccggaaccggtgccgggattgcccgacggattcaaggaagggccttttgtctttgaacgggaagggaaatactactttacttttccatgggtaagggacaagacggaaacgctggcctatggcatgggagacagcccgatggggccttttgaattcaagggaatcatcatggatgaatcgccggtggattgctggacgaatcatcattccatcgtggaatatcgggggcaatggtatctcttttaccatcataacgattattcgccgcattttgacaagaatcgttccgtccgcgtggattcgctcttttttaatgccgacggtaccatccgcaaggtgattcccactctgcggggagtaggaattacggatgcacgcacgcgcatccggatagaccgctatagcagcatcagtcctgcgggagtttccatcgcttttctggatgaggcggagccgttcaagggctggaagacaatcttcggtaagaagaatgcctggctgcaatataataaggtggactttgggaatgaaaaagtgcaggaactggtggtgcgtacccgctctttgtccggtggcgtattgcaagtacgcaccgggaagaatggcaagccggtggcgactgtttccattcctcgcagtaaggagtgggtagagagccgtgtgccggttgtatcggctcctacgggtgtgaacgatttgcacgtatcgcttctgaaaggctcgcaggtggaagtggactggataggctttgatgccctgccgtgggaggaaggtgctttcaagacccgtgaataccgtaatctgtttgcagaagcgggctataagcaggatgacattgatgccaaactgaaagaagtgttcgacggcgtattttatggacctgataaggtatattttgaggtcggtgattccatggcctacatcagtgacatcaaaaatcatgatgtgcgtaccgaaggcatgtcctacgggatgatgattgctgtgcagtttgataggaaagacatcttcgaccgcttgtggcgttgggggaaaaagtacatgcagcatcaggacggtcctctgaaaggttactttgcctggagttgccggacggacggcatacgtaatgcgcagggaccggcttcggatggggaactttattacgtcacttcccttatcttcgcttccaatcgctggggcaacgatacgggtatcgattacttggctgaggccaagaatattctggattgttccatgcagaaagccgggatggaccgtgtggctcctttcatcaacctggagcagaaactgatcacatttactcctgacccttggggagaacggtttaccgatccttcttaccatctgcctgcattctatgaagtatgggcaagatgggcggacgatggcagagcgggtttctggagagagtgtgcacgccggagcagggagtatctgcatcgaagcatccaccccgagaccgggcttaatccggattacaataattatgacgggactttgcttggtagcgaccggattatcggtgatgctttccgctttgattcctggcgtgtccccatgaacatcgctctggattattcctgggcgtgcgaagatgccgagtggcagcgggagtatggaaacaggatacagaattttctttatggtcagggcatagatactttcgttgaccagtataatgtggacggcacgccggtgaaggaaattttgggagccggagcgcataagcagttgcgccattcactggggctggtggctacggcggcggctgtatcgctgacttgtacgcacaacaagagccgcgagttcattcatcggctttggaatgcggagcatgttccttacgaagacggctatttcgatgcctattacgacggattgctcaggctgttcgcctttatgcatctgagcggaaattacagaatcatctttcctgaatgaagatgaataattgtttgtgtagaaccttaaaataagaatagaacatgaagcacattttatcgattggcattttatgcttgctggcggcttgtagcccgaaagagaatcagaaaacatttgtttatgagggaaatcctctggtaagaaacaactttacggccgaccctgccgcattggtacatggcgataggttgtatctgtatgtcggacacgatgagtattatgccggacaagatacggcttcgggaggcagggagttcaatattaccgaatggctgtgttactcgacgactgatatgaagaactggacagagcatggtgctgtattgagccctgccgactttaaatgggcggtgggagaagcgtgggcttctcaggtgatagaaagagatggaaagttctattattataccacggtgcaggcaggcgaaccttgtgtgggcaaagccattggagtggcggtaagcgatagtcccacagggccgttcacggatgctatcggccgaccgttggtgacggacgacatgacttccaacggtgcccgggggtggtggaatgatatagaccccaccgtgttggttgaggaggatggccaggcatggctgtgctggggaaacggcacttgctttctggcaaggctgaaaccgaatatgacggagctggatggcgacatcgcagtggtggatttgcccgaatacgtggaaggtccgtggctgcatgtacggaatggcatctattatctcacttatgcctcgatgggagagggacgggaaaatatcgcttatgccacggcttccggtatggaagggccttggacgtaccggggcgaactgaccggcatggcggagaacagtttcaccatccatccggccatcgtggaattcaaagggaagtggtacctcttctaccacaatgccgcactcacattggacggccgtgcaggtgcgataggccgtcgttcagtctgcgtggacgagttgcattacaatgaagacgggactatgcagtatgtagaacaaaccaaaggtaattaatgacataaataatagaactgttatgaaaaattctctttctttaggattgatattgtctggtttgctgctgctgaatgtggtagcttttgcccaagacccagacttgaccgcagaagaggtgctgaaaaatacggtcgctgcctcttccaatatgcacggttgtgatttcccacgcttagacaaggagaaccgggcttatttccgtctctattcgccggacgtaaaacgcttgcagatagatatatgcggtaaaaaatatgaaatgaacaaggatgaaaacggctggtggacagtaaagaccgatccgttagtggtaggtttccactattacttcttgcttgtggacggtttctcggtcatagacccgatgagttgcactttcttcggatgcagccgtatggcaagcggcattgaagtgcccgaaggaaaagagggtgattattatcgtgtgcagaatgtgcctcatgggcaagtgcgtacctgcacttactatgccgaaagccagcagcgtttccgtcgttgcgtagtctacaccccggccgaatatgaaaagaacaccaagaaacgctatccggtactttatctgcagcatggtatgggagaggacgagacgggctggatcactcaaggctttatgtataacatacttgataatcagatagcggaaggaaagtgtgtgcctatgattgtggtgatggaaagtggggatattgaagtaggtttccgtcctcgtcctggaaaggatgtggatgcggaacgtaatctgtatggctctgcgtttgctacgctgatgataaatgaccttattcccatgatagacgaaactttccgtacttatacagaccgggaacaccgtgctatggccggactgtcatggggaggaaagcagacttttgacatcacgctgaccaaccttgacaagttttcatacataggcggcttcagtggagccatcttcggactggatgtaaaggatgctttcaatggtgtgtttgccgatgcagacagtttcaacaaaaaggtgcattatctcttcttgggttgcggcacggaagagaacatgggcaccaaacaattggtcgagagcctccgtgacatgaatatccgtgtggacttctacgaatcgcaaggaacggcacacgaatggctgacttggcgccggtgcctgaatgaattcatcccgcatctgtttagagggaagcagaagtaattttgtgttatacaatgaatctcccgaaacagtccgggactggcatgatgcagagtgtcgtatcaatatatccggtcgctgtgctgatttggggcaaatattcaaacagagaaatgaacatacggagattttttttacttttatgcaacttggtcggctatgccttaggattgccggcacaacagactgccgtcaatccgctgatttatgccgatgtaccggatatgtcgatggtgcgggtggatgatacctattatatgagcagtaccacgatgcacatggtgccgggggtacctattatgaaatcaaaggatttggtgaactgggaactggtgagctatgcgtatgataggttgaccgacgatgttcctgccatgaacctggatgacgggcagaatacctacggacgtggctcgtgggcaagctgtatccgctatcacaaagggatgtattatgtttccacttttgcacaaaccaccggtaagacttattttttcatgacacgcgatattgagaaaggaccgtggaagcgtgtggagttcgcaccgtcttgtcatgaccatactttcttctttgatgaagatggccggaattatctgatttatggcaatggcaagttgtttattgcggaactggaggcagatttgtccggcttgaaaaccagtacggaacgggtgctgttggagaatgccagtgctccggcaggcggtgatattatgttgggggcagaaggctcgcaactgttcaaggtagatggcaggtattatctgttcaacatcacttggccaaggaacggtatgcgtacagtggtggtgcaccgtgccgataagataacgggaccttacgaagggcgcgttgtctttcaggaccgtggtattgcccaaggcggactggtggatacgccggacggacggtggtttgcctatctgtttcaggattgcggtgcagtggggcgcattccctatctggtgccggtgcagtgggaagacggctggccggtattgggggtgaatggcgtggctcccgacaagttggagcttccggcaggcaagggactgattccgggaattgtctgctccgacgagttcgtgcgcaaggcaggcgaggccgacctgccgcttgtgtggcagtggaaccataatccggacaatgccctctggtctgtatcggcacgtaagggttatttgcgattgaccaccggtcgtttggaatcttcttttatgcaggcaaaagggacattgacgcagcgtaccatcggaccggtttgttccggttctgtctgcatggacgcatcgggcatgaaggatggagacttcgccgggctttcgctcttccagcacaagtacgggcaggtgggtgtgaagatagtgaacggagagaagtgtattgtgatggtgaatggagaactggaagaaccggtggaggtagagaaaatcccgttaagcaggaatagggtttatttcaaggctgaatgtgactttagagaccggaaggatatcggctatttctactatagcctgaacggaaaggagtggaagccgttaggtagcccgttgaagatggaatataccttgccgcatttcatgggttatcgtttcgccttgttcaactatgctgcgaaagaaataggtggttatgcagattttgactatttcaggatagaagacagcatgcagcctgcggatacctgtcgggatgtggtatacagtggcatcagtgcctatttttcgccgattcgggcgggaggggcgcagcctgatgccgaaggatttataagacgctggctgctgttggagccgattgccaagccgaatcgtagtaatgcggtttttacagacagctatataaggaaagcatttacaacggaatactttccgaatcagtttacggttcttcccgaagcgggagcgaaggtcagggtgggcaatcagaaactgacatggcatgctttggacagcaagaacttcaatgttaaactattccgctttgcccatggactggataagaatgtatatggcgttctgttttgggctgtgacagtggtcaattgtgcggaagacattaataatgtaaggatggcggtaggctccaattctgcatccatgtggtggctgaatggagaggaagccatagtactttccggagacaggcgcatggtgaaggatgattgtgtatcaccccggttgacattgaaaaagggaaagaatatcgtccggggagcggtaatcaacggtcctgggatgagtgatttttgcgttcgttttttggatgaaaaaggacaacccgtaagaaatatttctgtcagttgtaaataaggggcagttcatggctctgtccggaatatgcagtggcactacagagtatgcacttccaggtgctgtctattcaattccgaaacgagtatttaaatattgaaatcattatgatagtaagaaacaaatggataggggctgtagcctttatgtcggcattttttgtggatacagttgttgcacaagttggaaagccgtttattcatgatccttcgaccattgtggagtgtgaaggaaagtattatacattcggtacgggaggaggtgggctgatttccgaagacggatggacttggaacagtggcgcggtgagacccgggggaggagctgctcccgatgtggtaaggattggtgaccgttatctggtggcttatggtgccaccggtggcggattgggtggcggacacaatggcgtgatttatacgatgtggaacaaaacccttgacccacagtctcctgatttcggatattcggagccggtggcagttgcttcgtcggatggtatcgaagacaatgatgccatagaccccgggcttctgctggatcctaccgatggacggctgtggatgtcttatggcacttattttggctttatccgtcttgtggaacttgacccgaagacgggaaaacgtatggaaggaaatcagccggtggatattgccattgactgcgaagctacggatttgatttatcgtgatgggtggtattaccttttgggtacgcacgggacttgttgtgacggaccgaattccacttacaacattgtggtgggccgttcgcgcaaggtgaccggtccttacatggacaatgtagggagaagtatgcttgaaggaggcggccgcatggtggtcgctgccggaggaagagtggtgggaccgggacatttcgggctttttgaccttggtgacggaatacagaaaatgtcatgccattatgaagcggacttggaccgaagtggaataagcgtactgggtattcgtccgttgttatggaagaatggttggcccgttgccggtgacaatttcaaagaaggtacttatgaaatagaatcagaaagaagaggatatgccttggaactggctgtggattttgtaagaatgccgggaggcatgcgctggtttgaacataccggacctatagaaccgatggcttcgcaaactttggcggatgttatagacacctggccgacaggaaacatcggagtgagggcaggtgactatatgttccgtccgcatcagcggtggacaattacggctgttcgcgatgcgggaggttatttgggagcgccttattataaaattgtgatagaagggacggagcgtgcgttggcggcaaccgctgaagcggaagttgtaacggttcctgcatttaccggtgcacccgagcagttgtggcggattgatcaattgacggatggtacgtaccggattatgccgaaggagattcccggttcgacggagaagctggcactgatatctattggtgacagtacgcctactcttgccaagtttgataaagatagcgataattccaaatggaattttaaagctcattgatagttcgcttctctctctgtaggtttaatgcagtttttctcaggtgcgaattacacggaacttggatttatagtaaaaacaaattcgggagattccgtgctattcgcgcctgcagaatatcttttccggaaaataggctttcatctgtttttattcaacaattcctttgtaggacattcatagttgctgataatcagtttgactcttttcaaatcctccaattcgtgtataggacgttccatcgacggaggaatgggtaactgggagtattcctgaaaatagagcaggcaagcatctttccaccagacagcatcgcgtacttgtgtcttcaagcgtgattgtatatctttgaatcgttcgccgtcaacgtattcctctattttatcccatattttctggaactcccttacttgccgtacgccgttgtcgtagtggcggcaaagttcctcccatagggaatttccgcttttcatccggaacgtccaaggcacgtggtggaaccagagaagatacttttcggggcacgtggtcaagtcgtcgtagagcctgcagagtgagtcaggatattgtgcagtggcattactgccggtgtgactgcggttgaatccaattcctatactatcggcattatgataataggacggcatccagtcgggtcgtgcgtcgggaatgttgcaccaaggttcgggaccgtagtgatgtccccaggcaaaaatatggtgtagtcctaatggcatcatgtagttaacaaccgcttcacgactttcgagcatcatctggcttgccggcccaacaaaatttttctcattgctgaaagtctgccttaaccattcgtctgctatttcttcggaagagattgccgggttccaggccaggcgtccgaaagcataccagttggcttgtgcaaagggatgtccgcaccagtttttgtctgtacctatattggcaacacctgcaacggctcttaatgaagaaggtgccacaaagcggaagaactctttccacatgggtgccagataggcaaggtggttggaatgtcctaagtattcttgggtaatttgaaattctgccatgagtggagtctcgtgcatggctccgaagagtgggttgtaaggctcacgtggctgaaagtctattggaccgttctttacttgcaagatgacgtttgaacggaatttgccgtccaatggtttaaactcggtgtatgcttgttttgcgcggtcggtatccgatggattatagacgaaggcgcgccacatgacgatacctttgtaaggtttgagggcatcggccagcatattggcgccttcggcatgggtgcgtccgaagtcgcatggaccgggttgtccttcactgtttgccttcacaaggaaacctccgaaatccggtataagtcggtagatttcgcgagttttgtctttccaccagcgaatgacttgtttgtcaagtgggtcggctgtatgcaacttgccgagtataatcgggctggcaaagttgacggaaagatatacccgtattccataagggcggaaggtgtctgccaacgtctttaccttttccagatatgccgtagaaagaatttggggagaagcatttacattgttcaatacagtaccgttgataccgatggaggcattggcacgggcatacgcttcatatctgccggaggatgtgccgggcagttcttcccaatcccagagcgactgtccggcatagcctcgctctacggttcggtccatgttgtcccaatggttgaggatgcgaaggctgtaggccggattctccgtggagggacggatgggcagtccgctttcttgcaggcggagcaggtgaaaggctccatatagcaggccggttgcagagggggagctcaagacgagcttcttctccgtgcattgtatgcggaaaccgtccggggcaagttgcttgtctttctctatcagcagagcgaccggatttcctttccaggactgccgcaactcttcggcggccagattcaaggttgcggatgtgcattgggccgatacctcgacggaggcatttgccccttgactctgtcttaaccacaaaaggctgccatcttcggcagccatttggtttgtaaagaagaaaacgatgcagataagagagaagaatctgtatttcatgatattttgtctactgttgtttattcaggatttccttctatggtgatgatttttccttcggagtcatattccagttcgcagaccttgaggctgcgaagccatgtttttccgttggaaggtacgcagtcgtggtggaaaagataccatttccccttgtattccgtgatggcatggtgcgttgtccatcccacaaccggggtgaggatgactccttgatagacaaaaggtccgtaaggattgtcaccgatggcatagcataagcggtgcgtgtcgccggtggagtaggagaagtagtattttccgttgtacttgtgcatccagctggcctcgaagaagcgtcgttcattgtcgccggctgtcaggggcttgccgttttcatccagaatgactaccggcttcggctcttcggcaaattgcagcatgtcgtcgctcagttttgccacgcgtcccggtatggacggttcgttgtccggggggaaggcggcgctttccagcgccttgttgtcgcggtagcgttgcagttggccgccccacagtccgccaaagtacatgtagtagcagccgtttccgtcatccagtatggcggggtcgatgctgtagctgcctcttatcgggtctgcctggggtatgaaaggcccttcgggcgagccactgacggcaacgccgatacggaagatgtcattttggtctttcaatggaaagtacatgtagtatttgccgtctttcaaggctacgtcacagtcccataactggcggcctgcccaaggaatgtcttcggtggcgagcaccactccgtggtctttgatttcaccgtgcatcacgtcgtcggtagagaagacgtgatagtccttcatgttgaagtggtcgccgttgtcgttttccggtatgccgctctcccagtcatggctgggataaatatagactctgccgttgaatacatgcactgccgggtctgccatatagtcttccggaaccaaatatctcatttctttcttcatggtgtattatgttttagggtgtttgcaacagttcgcgtacgaatggtttgggctggtaattgcggtcgaacagtagcgggtattcccggcggccgcgcatgggaaagtcgtttttccatgagtcgccgtcagatattccccatgcagtgacgcgtgtgattacatctgcatgtttcaggaaaaggtcgaagaaggacttcatgcgtgcattccaaatgcggctgacactgtcgggcaatgtttccggataaggattcaacgctttccggtatgctgcggtgtccgagatgtttgccgtgtggctgactgtgggaagggcgctcatgtcccattctgtaatcattactttggcaccggtggctgcaaaggcgagcaggctcttctcaaagtcttccaccgtgggatagtccatgcccatatgtccctgcatgccgacggcatcgatgcggatgcccttttctttcaatgagcgcacaagggcggccactgagtcacggcggcccgggacattcatgccatagtcattatagtaaagttctgcttcagggtcggcttcatgggcgcattggaaagcataggggatatactctttgcccaatatctcatagaatttggttttgcggtatgaaccgtcttccataatagcttcgtttaccacatcccatccgtgtatgcggcctttgtatctgccgacaatggtagatatatgttccttcatgcgttgcttcagaacctcaggtgagacattctttcctgctgaatcgacgcagaaccagggagctaactgtgagtgccagataaggcagtgaccaatgacggccatgccattctcttcaccgaagtctaccaaggagtctgccggtgtaaggttataccggttttcctccggatggatgacctcgcatttcatgcagttctccgcgacgatagagttgaagtgatgtttggcaatggcaatggcagcagtgtcttcgccggagacttgccgttggttcaacgccgcaccgatgagaaatttattgccgaaggctgctttcagtgaagaagattcttccgaaggcgtggtgcgttttccgccgatgcaagccgtaacgagtccggcaatgacaaggggaagtagtgtttgtttcagtttcatgttttctcttatttcagtttcgtatgttgttcaacttattagtaaacaaggtgtcagttgacgagtggaaaacccttgaaaatgattctcacgcatcctatcttctttaataaacccgacactcttccttgtcaccttgtcaactgcgaaagttgagcttgcgaaacttgagttaataatccgtttgttttctccgttcagtcagttcagcctgcatttcctcattgtaggctttcgtgatggggtagaagtataatgcaatgactcctatgaagaatgtagcagccggtatcagacttgaagaaagtattatgccgtggatggccgattctgtttgtgctgtgcctgctccgctgacatagccaaaaccggaaagcaggaatcccagaatagctccaccgattccaagaccggcttttaatgcgaaaactacccctgcaaaaacgaatcctgtggcacgacggtaatttacatattccgaatggtctgctacatcggcaatcatagcccaaagtaagggtaccgttggggcgtaagcaagacttttcaggaaatttaggacaaacatggtttctatatccgtttcattggggaaatagaacagtgcggtaaagatagctgtcagtgtcagacagaagataaacacacgcttctttccataacggttggctaggaagctggataataggatcactccgaagaattgtaccagtgcaccgaccatgttgaaaactccaaagcctacttcgtacgctttctccggactattgactatcaatccgaaagcatttagtatattgtagctaaaacttgcatttgcttctacggctaccagtcccaatttgtcgaggaaagtatatagggcattggcatctacatagttctcaaagtagtagttcatggcacttccccacatggctaaggtggtgaaaaggaatagggtgaggatgaacatggctcgccagggaatactgtggaacacatctcttatatctttccgggtatcggtcttttggctggcgggtggggttatacgttctcgtgcagaaaaaaaagtaatgataaagaatataaaaccgattgctgcaaacagagagattgtgcaaagccatccgtgccctttgtcaccatttgcgccggcaaatttacctacaaggggcagcgttaagccttgcacaataaattgtgctatggtagcggctacaaagcgaatgctggtaatgctgttgcgctcttttatatcactcgtcatgacaccgcctaatgaggcataaggggtattgttgaatgaatagagagtcattagtagtgtgtacgaaatagtggcatatactgcaactaggcttttgtcttcaatgccgggattatagaaagccaatacatagaataccatgaacggtaaagccgtccataatatccaagggcggtatttaccccaacgggtttgcgtcttgtcggataagattcccacggtcgggtctacaaaggcatcgacaatacgggctatcagcatgacactgccggcaatggcaccctccaagccgaatacgtcagtatagaacttggtttgataaatcatcatcatctggaacactaagttcgcagagcaatctccgaggctataacctattttctccgagattgaaattttctggttcatgttgttcattatggtattaatctgttgtaagtcaattactgttgtagcttaacctccttattgtattttagcgcagtttctgctgcacgttgccccaacgtcttcttgtccagtggatgtatgtcgttccactctcccagatcgctgttcttgatgaggtaggtattggtgttcatttgggctgccctggcttgttcgtgtcgcatttctgcccaggctttacgtccctggatgtcattctttgcaaggaaatctgccaactcgacaatgtagaaaggtaactgctccgaattgaaggtgcgccgccagtcgctaatcatggccgacaataatgctgcgtattcgttgcggcgtgaaacgttggactcgccttgataccacaatgcgccgcatatgccataattcttgagcggtgcaatcatggcgttgtacagacaaaccggtttgtaacaaaagaacatcatctccggagcatcgggcatcggggctcccaaacgatacttccatgtcggtttgagattgagctctttggtttgttccctatctgttgcctgataaattattttatagggcttttctttgacaaaacttggttggccaccattgctgatgaggcgtacagtaatattgttttgtccggttttgagtacaccagccgggattctgtaaatacgtggtggatactggtaagttgtattgcctataaatattccatttacatatacagagtctgcatcaacgatgcatcccaagcggaggatggcgtcacttcccggcgcaatgtcggttatggtaacatcctggcggaaccagtgggaaccacctatcggattcaggccattgtttccccagtcggctgagaacatgtcaacctcttgccacgtatggtcgtcatagttttcactataccatggcgtcgcttcatgcaaccctgcatctccacggtacagagattcgttccaatgacggaatttctcattttctacttgcttgatatgtgtgcagaacttgtcgtcttcatattgccgtttgtcattgatgtataacgggaattgcctcaggccttcctcgctgacccatgcttctacaggagtccccccccaactggcattgatgatccctatcggaatgtttgtcttttcatacattgctttggcgaaaaaataggccaaggcggagaaatccatcacattgtcttgtgtcagtgctttccagcttgtttgcggcatatcttcttgtggcgcatggaaattatagacctttggaataatgatatggcgtatcttttcattgttatagccggctatctcatcggcaaacatatctgttacgcggcttatgggcaattccatattcgactggcctgagcagagccatacgtcgcccaccagtatgtttctgatttcaatgtcgtttatcagcatggagtaagggccaccggctttcatggaggggagggttatactccactgcccgtcggcatttgctgtggcagtgtagatgtcttttagttttttatttgttgtggaagtcggaaaagtatctttggtaaatcttacttgaatgctttctcctgcatctgccgttccccatacttttatggtttgttcgcgctgcaataccattccgtctgaaatcaaggcaggcaactttacctttgctctcaccatcacggtgccacaaaggcaaagtaacactgccattcctaacctaactttattataaccattaaacatcatatcttaatcctcttatatttatttgtaatcatatagcactacgtgtagaatgctgaaatgtcctgtcggaattctgacatgccgtccctggtgactctggtcaccgttcatccggcggatatatccgaggcttctgtctgcattcaccttcacttcgtctacaaatccgataccgcaacgcttgccatgccatgccgtcttgccacttccggttttattgttttcatttccttttcttacgaagccgtcttcgcctaacaccttgtgtgttccggcagttgctttttctgtgtttttagcaaactcgatgacgattccgctaccggctattatatattcgtttttcgacattcttagcaagattcctcctccctccggccatacattgccgcctgtggcacgagcatcccacggcagtgtgaaatagtggcggcaggttatggtcaaatcatcttctgtaatgatgcgctccttgttctcttggtcgaaaagcaatcctttcatcactcctttgccttgatatccggtaagcaatggcatcaattcctttaatttcccatagctttgtaccaatggcgcgtctgctgactcaggactgtcttcgatggagaaaggactgaaacctattgcgtcatgttcgccgaacacatagaaagcccttaccccgttattgtctgtcaaccggatttcagggatgaataaagggttgttgtgcagatgatattgagatacccagttcgtgaaatcattgtcatataagtcgggggccagaatatcgatatcgggtgctccgcaatgccatatatcaatcaaatgtgctaacggtccggccgaagggtattccccgggtttgcgtcctctgctgttcatggctgcattgacatagagtggcacattgtagatggagcgagcgctttgtgccagtttccctacatacttggcataattccaggccatgaagatttcatcggtatagatgtctgcaccgaatacctcttgccagttcccttctctcttgcagccttgtgcttcccattttttcagcaaccggggatgaaggtcttttttgtgcttttgcaggtaagatgccagttcttgaggtatcggggcgcaaaaagcactgttggcttccggtgaataatcgcgcgcgtcttccagcatgccgatttcattttctatttgtatcatgatgactgtaccttcatctctgtcggcggcagcgatgtgtttcagccattgggtaaaggcgcgttggtcggcttgcagcacttcatcggagaaagcactggctatttcaaggggcttgccgctttcggtatgcgcccgagggtatttcttgtcattttccttgaaccaaagcggcgcatagcaactcgtggaatttttccatgcaccgaaccataaaaagacaactttcagattgtacttgcgtgcttgctccaagactttatcggtcaatgtgaaatcgaaatctccttctacgggttccagcaaatcccagtatgcagggactaaaacagtatttagtcccattttctgcagtttgggaaagatgcgttcaatgtcttgcgtgtttgctgccgatgaattccccagttctccgccaagaataagatagggagtatcattaatgataagttgggtggcattccctcgtctctgcaaacagcttttctgggcacggccatatccggctatcaatagatttaatattaagagtaaaaagattcttttcatcaatccacagcattagttatgaatgcaaagatagtgctctgtcctttaaaacaggctaaggaatgttgcacaaaacattatataggtaacatgtgcttttgtgtatgttacataaacttttgtttatcgtacattttggacttgaagtgtctttaagaatacatttgtttcaataaaatgaagaagtttcttacctttgcttaatcttaccgtaatatcgagtactaatatgaaaacacttgtccggtatatatgtgcttgttccatggcacttgtaatgtttgtaccatattctcttttgatggctcaaacaaggaatttttattctacagaaaacgggctgtccagcagtttgataaaccagcttttccaggatagccgtggatttatatgggtggctacagaatatggattgaatcgttttgacgggcttaatttttccaattatcgacatgtacccaatgattccgtttccttgacgagtgattatgtacgtactctttttgaagatagtcgtcaaaacttgttgataggttgtatcaatggtttgatggtgtacaaccgggaaacggatactttccgggaaattcctatgatacgtgcaggcaagcgggttactccacatgtcacgcacttgcaagaagtccgtagcggtgaaatatggttgagcaccagcgggcagggcttgtttcgtctggacagtctgctgaatcgggctgtatctgttgacggtctgtttcagcagataaattgtacttatcaatctaaattctgcattgattcccgttcggaaatctggataggaacggagggaaatgggctggcccgttatattccgaagtcaaagcaactgcagtttttcaagtatcccgcatttggcgataacaatgtaacttccattatagaagaccatttggggaatattttcgtaggtacacaaaaacaaggagtatcacgatatgataatgaaacgggagagatggtatctgtttcttatagtggatatgatgggcagctatctgtatattgcatggctatagtggacggacagctttgggtaggaactgatggacaaggagtgaaaatctataatcccttgaaagatcaattggaagattatcggataaattctgcatcggtggatttttcgaaagggaaggtgcattccatcatggaagacagggatggcaatttgtggattggcctgtttcagaaaggtattgttctggttccaaagcaagaaaatccattcgagtattatggtagcaagtctatttattataatcctatcggacaaggatgtgtaatgtctgttttccaggatagtaaccggcatctgtggatcagtgctgataatgagggcctttatgaattggggatagatggcaggcgtttacgtcattatcatcctgactattcggagaattctgtgcctaatgttgttatgtgtatatatgaagatacggactataatttgtggataggctcttatggccaaggactggctaaactggataaagctacagggaaatgtgagcatttccaacagataaacaaccctattgtgtattccattgctgaagataagaaaaagaatctgttttttggagtatttggttccggtttttatcagtataacctgcagtctcgaaaactggagcattatgaatcctccaaagatgaaaaaggcgacttgaaatgtgacgaattggtaaacgactggataaactatattttttgcgacagtgaaggacttgtttggttaggacattataaaggagtgagttgctttaatccggaaacgaagagcttcttgaactataaacaaacgaatacattaataaccgattgcataggatatgcatttgccgaggaccatgctggaaacatttgggcaggaactacaaatggtctttattgtttctcgaagaaaacaggcgaactgagacaattcacaatttgtaacggattgcctaataatgtgatttgtggcatttgtgaagatgaagacgggaatatctgggtcagtacatataaaggcatcagcaaatatgatgtaaaaaaggattttttcgtgaattattattccggagatggcttgcaggggaatgagtttacgcatggtgcatactataaagacgaggatggcaaaatttattttggtgggataaatggcataaccagtttttcccctaggaagataaatactgatgcaaaagaactaaaggtttatattacagatttttatgtgtatagcgatcccgtgcataaaaatactctttcggatggaactcctattattttttcttcggtacaggatgctaatatttttcaactttcatatcgtgacaatacattcagtattgctttctcaactttgcaatataataatcctgagcagatagcctatcagtataaaatagatgagcttagcaaccaatgggctgtaacggaacctggagtgaatcgtgttacatataataatttgtttcccggtaaatatactttccgcgtacgtgctcttaatcatggtaattattcagaggtgcgtactatcaaaatattgattgcttcgccttggtataaaacctggtgggcgtattgcatttatattggactggcagcattgcttgtgtggggaattgtaaacaatgtgatgtcacgtgtgcggtatcgtcgtgaaataatgaagcgtgaacatgacgagcagttgaatgaagcaaaattgcagttttttataaatatatcccatgagattcgtactccgatgactttaatcatcaatccattggaaaaactgttggcaggagaaaacaagggggaattacataagacatatctgatgatataccgtaatgcccaacgcattcttcggttgattaatcagctgatggatataaggaaattagacaaaggacagatgttcatgaaatttcaggaaacggatatgatcggctttattattgatgtgatgcagccgtttgaatatatggcacataaaaagaatatagactttgcttttatacatgatatgcctcagctaaaagcatggattgatttgaataatttcgataaagttttgatgaatgtactttccaacgcttttaaatatactccggaaggtgggaagatacaagtcagtctttctataggcagagatgtctcttgcaaagatgcattgcagaatttttttgaaattgtggttacagacagtggcattggcattgataaagataaaatagaacgtatttttgaacgtttctatcaaatagacaatgatgtgacaaagtcgaatttcggaaccggcatcggtctgcatttgtcccgcttgctggtccggttgcatcatggaaatattcatgctgaaaatagagaggatgcttcaggcagtcgtttcattattcgcatgccgttgggttccggacatttaagagccgatgaaatggtggaggctgcatcttttgccgtttgcccccaagtgccgaactctaaagaagagtatatggacgatgttgacgagaagcaagccggcaagcctaaaacccgtcaaagggtgttggtggtcgaagatgaagaggaaatcaggacttatctgaagcaggaactgtctgatgaatataaagtggcaatttgctgtaatggtaaggaggcatatgattacattctgaaagaaatgcccgacttggtaatcagtgatataatgatgcctgaaatggatggtttggaattgtgccataaactgaaacagaatactaatataaatcatattcctattgtattgctgactgcaaaatcaagggtagaggatacgttggaaggaatggatacaggtgccgatgcctatattgtgaaacctttcaatacggaatatctgaagagtactattgccaatctgataacgaatagaagattgttgcgcaataagtttagcggagcccagcaacaacaagataaaatagagaaaatttcaatgaaatcgaatgatgagatattgatggataggattatgaaggtggtgaacaaacatttggatgatccggaactcaatgttgaaatgcttgcttcggaggtagggcttagtagggtacatgtacaccgcaaattgaaggaacttactaatctgtctacacgcgattttataaagaatattcgtttgtcgcaagcagcatctttgttggatcagaataagaaaatgacaatatcagaagtcgcttatgccgtgggatatactaatttgtcgcatttttctaactctttcagagaaaaatatggcatgtctcccaaggaatatatgaacaagcctcagtagataagaattatttctcccttttttcttttcattccttcatttatattcatatatatgtttggattctacttgtaagaggtaagtaaatggggcttttaaattgtaataaacattaaggggttgcccaaaaatggacaaccccttaaagtaattataaaggaaagcttctttattttgaggcttcaccaagctcactgctcttcttgtttttcatcaacagatatgcgataggagatgctacgaacaaagaagacaatgttccgaatacaacacccagaatcatagcgaatgcgaagctgcggatggaatcaccgccgaggatgaagatacacagcaacacaatcaaggtacttagtgaagtattgatagtacgtgccaaagttgtattcagtgagtcattgaacaattggaacttgtcgcgcttcggatagagaccgaagaattcacgtacacggtcgaagattaccaccttgtcattgatagagtaaccgatagctgtcaggatggcaccgataaaggtctggtcgatttccagagagaacggcatccagccccaacagatagagtaggcacccaggatgatgatggtatcacaagccaatgcggctactgaaccgatactgtatgcaatattgcggaaacggatcaggatatagataccgatggcaatcaatgcaagtacaacggaccagatggctgaaaccttgatatcgtctgcgatactcggacctaccttctgggaactgatgatacttccgcccgtatggttttcgcggtcgatgaaggtttccaaagtgatgttctgagtcaataccggcttcagagtctcatacagatatgcttcgatttcagagtcgatgttgttaccttcttcttcaatgcggtagttcgtgctgatacgtacagtcttgccgtctgtaccgatagcgataacgctgacattggcatcgccgaacttgctggagataagttcacgaatctgttccggttccactttgttctcaaactgtaccttgaagttacgtccaccggtgaagtcgatgctctggctcagtccacgggtagcgaggaaagcgatgcatacaactacggcagctccggtgatggtcaaccacagcttgtttctgcccatgaagtcgaagtgtacgttcgccattaggttcttggaaatcttggaagagaatgtcaggttcagcaatttgtctttgcccatgaaataatcatagaacagacgtgtcatgaacacggcagtaaagaacgaaatcaagataccgataatcagtgtagtggcaaaaccgcggataggacctgtaccgaagttgaacaggatgataccggtgatgatagacgtcaagttggagtcgaagatagcagagaaggcgttggagtaaccgtcagccaatgctttcttcacacccttgcctgcacggagttcttctttggtacgctcgtaaatcaatacgttggcatccacagccatacccagcgccaacaccataccggcaataccggacatcgtcaatgctgcctggaaagaagaaaggatacccaacgtgaagaacaagttcagcaccaaagcaccattggcaaccatacccggaatgaatccgtacatagagcacatgtaaaccatcagcagaatcaatgctacgatgaatgacatgataccggcattgatggaagcttgtcccagtgaaggacctacgatatcttcttgtacgatgtgcgcaggagctggcatcttacctgatcttaacacgtttgccaagtcttttgcttgttccggagtaaagtgaccggtaatctgtgagttaccaccagtgatttcattgtttacgttcggtgcggagtaaacgtaaccgtccagcacgatagcgatgctcttgccgatattctgcttggtgagctgagcccaacggcgtgcaccgtcagtgttcatggacatacttacggcaggtttaccgtaatggtcgtattcgtctttggcgctaaccactacatcaccttccagaggcgccttgccgttacgttctgtagaacggatggcataaagttcgaaagtctgagctttcggatcatattcataaggagatactccccatttcagacgcaagtctttcggcatttcggcctgaacttccggcatggaaaggtatctgttgatttcagctgtatccttgtagttggcataggctacaacaggaccttgtccgctggggttgacttgcaagattgcgaacagcgggtgttctttctttatttgtgcaaggtcagcggtttgtgtcttgttttcaccctttaaagcagcggcaagactgtcggctgtgctggtagcttgggctacggcaggagcttcggtagctgcgctgtctgcctcttctgccggagtttcgcttgcaacgatggcacgcaacttggtgtcggcagcttgcagatagggagtaacgtcttttgctgtgtatgtttcccagaattccagattggcagaaccttgtaataattttcttacacgttcaggctctttgatacccggaagttctaccatgatacggcccattttgtcttccaaactctggatattgggctgaactacaccgaaacggtcgatacgggtacgaagtacattgtaggagttgtcaacagctgcctttacttcttcgcgcaatactttctcaacttccgcgtcggtagatttctgagttaccttgtcttttaattgttgggttgcgaacagctgtgacagcggagcacccggagcaagcttgtgatactctctgacgaatagggtgatcacgtcatcctggcttgtggtagcttgcttggcggcagtggccaatgcttggttgaatgcttcgtcagtcttgttgtcagccaatactttgatgacatcgggtacggaaacttcaaggatgacgttcataccacccttcaagtccaaacctaaactgatttccatctcacgacattgtttcagcgtccaattgccgaaatacactttctcattagccagagaatcgaggtagtcctgctctactttcacatcgccttttgcaaactctttggccttacttgtgtaatggcgagttacaaaagagaaggagagatagaacacacacaccagtgtgagcaatatcgcaaaaacccttacaaatcctttgttttgcatgttacttttagtttattatgattactttttaattaaattctgttgcatacaaggctgcaaatatagcttttttttcacaaatcttacttcataccgcgattttttaacatcgggtctaattgaggctcagttcctctgaagtttttatagagagtcatcgggtcttcgctgtctcctttctccagaacattctggcggaagaggtcggctgtctgcttgtcgaagataccgtgttccttgaaagcttcgaaggcatcgttgtccagaacattggcccagagatagctgtagtagcctgcagcataaccgccgatgatgtggttgaagtatgtggtacggtagcggggagctatttccggaatcagccccagttggtccatcgcttctttttcgtatgcaacgacatcaagaccttcggtatcagtcaggttatgcaggttcatgtcgaggatggcggcggccagcaattcggtagtcatgaaaccctggttgaatgttttctggttcagtatcttttcaatcaggctgtcgggaatgacttcgccggtcttgtaatgcttggcatacattttcaacacttcgggttcggtagcccaatgctcgttgatttgagaggggagttccacgaagtcgcgtacgacattggtgcctgaagtacctttatactggcattgggtcaataatccgtgcagggcatggccgaattcatggaacaaagtttccacttcgtcgatggtcagcagggaaggagtgtcgcctacgggcttggtgaagctgcatacgttgcataccaatggacgtatgctgccttgttgttcgcggtaattgctcatccaggcaccaccgcttttgccgggacggggaaagtaatctacatagaagattcctacttgtgagccgtctgcggctttcacttcaaacacttctacatcgggatgatagacggggataccttcgagctttgtcagcgtgatgccatagagcttattggcaacggcaaaggcgccttcacgtacgttttccagtttgaagtagggcttaatctcttcttcttcgaggttatatttctctttacggagtttttcggtgtagtaccaccaatcccatgcttccagtttctctcctttgccttccttgtccatcagcttttgcagttcggctgcttcggcttttgctttggggagtgcataactccacaagttgttgaggaagtccatcacggcggtggaattctttgccattgtattgtccaatacaaagttggagtaacagtcgaaacccagcagttgcgccttttcaagtctcaggcgtacgatgtcggtaatgattttcttgttgtcgttcttgtcattgttattgccgcggttgatgtaggccttgtacatctgttcgcgtagcggccggttagcagagtattgaaggaaaggcaggcggcttgcattatggagggtaaacagccatttgccttcctgtccggtggcacgggcttcagccatggcgctttcgcggaaccattggggaagtccggcgaggtcttcctcttttcctacataaagcttgaagtcgttgttttcgttcaggatgttgttgctgaacgtgattccgagtgtggaaagctgcttgttgatctcacgcagacgggcttgtttgtcggccggaagattggcgccggaacggataaatttcttatgggtcttttccagcagcctttgttgttcgcgggtcaggccgagagcatctttctggctgtagacagcatccactttcttgaaaagctcctggttgagggagatgttgtcttcgtgttcggccaatgtcggagccagtttcatggaaagggctgtcagttcatcggtagtttcggcctccgtcaggttgaaaaatacaccgcctacacggtccagggtgggagagctgttgtcgagggcaacaatgacattttcgaaagtaggggcttccgtattgtcaatgatggcttggatattggcgttctgctcttctatacctttctggaatgcgggttcatagtgctccaacttgattttatcgaatggaggcacgccattgggtgtttgaaactcagtaaggaacggattgctttccgtctgggtggcacaggagtacatcatacaacttgctgctaaaattagaatacattttttgaacattgttttctaagtattaaatgtttaagtattaattttcaatatctcttagtgatatagcaccatatcggatagtggtctgactctttgatggagcggtctactgtacaattgtaggctctcaggttcttgcttgtcagtatgttgtctatccggaaatagaatctgttttggttgtaggagatgcccaaccctcgtcctgattgggtgaatgcgtcgtccaaatcctgggcgatggtgcggtgggtataggagatgggggtatcgttgaaatcgccgcatacaataatgtaaggatgcggtgaagcggctatttcatgtgcaatagtgtcagcttgcggggcacggatggccgatgcttctgccagcttgcgtatgagcaggcgtgcgccgcttttcactttttccttttcgggagatttcagcatgtcttcgtacacgactttatcggctttggtcagcttgttggactccagatgattgttgatgagggtaaccgtgtcttccccaatcttgatttcatagagtaccgaaccgttgtattcgctgggataatccaatatgcgtgacgagagaatcggaaatttagagtaacatgctatcttgttggtatgtccctttccgctacccactgtgttgatgcggtggtatggatatgccttgagttcccgctctacgtctttttgcgaaagatgctttgaggattgtactgtggaatattcctgcagacagaggatatcggcgccactttccttcaaataggtcaatatcgggtttttgccatcttgtttggcggcaccgtcaaatcccataatgttgtaggagagcagtttgatacttgtttccggtaagtggtctgtatggaagttgatgggcagataggtgcgtatctgcgaatagcagagcaacatccctattaggggcagcaaagccgacctatagcgctggatgaccagccaaaaaatgaggaagccggcatttatcatcaggaacacgggaaatgtcagccccaggcacgattgcaccggatgtgtgaccggctggatgtgcggactataggcggtgaacagtaataggcccgtaaataaggcattgaccgctaaaatcaggagagcgacaaaattaccgagatgcttcattataatagttgaaaattgaaaggtgaaaactgaaaataagagtggcggttatattctcatttttcattttccgttttccattttccattggtttaacgtttactcgcgtcgaacaagcttttcttttcctctgtagtaaggctttcgtatcccgatttctttaatttgtcgagaatgcggtctatctcgtcggattgggcttttttccgtgcgttgtaatcataatctttttgtttgccagtaccgtagtgtactttcattttcggctttctgggtttgaagctgacgatggaaactaaggtatccagacatttgtttatccatgaggtcaggtcactacctttgctgaggctggcggcaaaccatacccctgccagcgcacctcctaaatgtgcgatgtgtccaccggcattgctggaggtgatgaacagtaaatcggtgcctataacgatgagtgccaggtatttcagccggatggttccgaacagcagtagccgtatcggatagttgggctcgcgataggcggtggcggctacaatggcaagtacagaggcagaagcgcccagcatgaaagaatagtctgtcatgggacggaaatacgggaaaatgttataggcggccatatagagcagaccgccgcaaattcctcccagaatgtatacaccccggagatgctttgcagagaagaaactcaggaacagtgcaccgaaccagtaaagccacagcatattgaaaagaatgtgcatgaatcctgcatgcatgaacatatatgtcagtagtgaccatggttgcaggatgaagcgtaggactgatgccggcagttccagccattcgaatacgcctgctatgctccggttgaacaactggaacatgacttcggttagcgtagtaagtatgaataccgctacattgatgtaaatcagttggatataaatgttccccctacggaaggtttctttcaaatcagttataatagtagccatttcctctgttcttttttctccagtacataattaggataaagccgaataccataccacccagatgtgcgaagtgagccacattgtctcctgcactgtttgcaaatccggcataaagttcaatcaaggcatatccgataacaaaatatttggccttgatgggaaccggtaacgggaagatgaacatttgctggttggggaacaacatgccgaatgccagcagaatggcgtatactgctcccgaagctcccacggtagtcatcatattgagatattcctccatcgggatgatggccatgccagtatttacgctgtcataggcggaaagtactgtctcataatgaatatactgtaccacctcctggataattccggctcctataccgcacaccagatagtagaacagaaatcgttttggcccccatacctgctctaaaatacgtccgaacatccatacagcaaacatgttgaaaaatatgtgcgcgaatccggcgtgcatgaacatatatgttatcaattgtgctgcattgaaatcttcggcaaggaaaaaatgcaatcccagatattgggcgaggtcgatgccgtagctttgggcgacaatggtgcccaaaaacatcagcacattaatgattaaaaggtttttggttacagtaggtatagtattcataatctgttgtttcaattcattttacagttcaaaaacagttgtctgtttttgctttctccggcaaaaatacgaataaattctgttctataacagaaaaagcagattctattccttctttttcgctgttttccaatatttttttaatgtttttatttgatattcagaaatattgctctatttttgtggaggtttgtgatgaaaagtaaaaatatcttttgtgtaacatattaattaattttaagcattatgaataaggcggaacttattagcgctatggcagcggagtctggtttgtcaaagactgattcaaagaaagcattggatgcatttatcgcatcagtcactaaggcaatgaaggccggtgataaagtatcattggttggttttggaactttcagtgtggtggaaagaggagcgcgtatgggtatcaacccctctactaaaaagcctatcgagattgctgcaaagaaagttgttaaattcaaaccaggtacggaattgacagctgaataagaacagtatactcaacatacaaagaggggacgttttacaaagagcgtcccctctttgtatgttgaatatcttgtgaggccataaaaacaagcctgcttgttttgtactgatttcggtttacgctatctttgcacgcaggaaaatacatttgaatcatgaatatagaacagaaactggtatcgtccgtcatcggcggactgaaagcgctttacggacaggatgttcctgccgcacaagtgcagttgcagaaaaccaagaaagaatttgagggacacctcacgctggttgtattccctttcctccgtatgtccaagaaaggaccggagcagacggcccaggaaattggtgaatacttgcaggcaaacgagccttcggttgcagcatttaatgtcatcaagggcttcctgaacctgaccattgcctcctctgcgtggatagaattgttgaatggcattcatgcggacaagcagtacggtatcgtggctgctactgacaactctccattggtgatgattgagtattcttctcccaacaccaacaaaccgcttcatttgggccatgtacgcaataatcttttgggaaatgcgctggctaatatagtggctgccaacggtaataaggtagtaaagacaaatattgtcaatgaccgtggaattcatatctgcaagtccatgttggcatggcagaagtacgggaatggtgaaactcccgaatcatccggcaagaagggagaccacttgattggcgattactatgtttccttcgacaagcattataaagcggaagtgaaagaactgatggccaagttccaaagcgaaggcatgaatgaggaagaagccaaagccaaggcggaagctgaatctcctttgatgaaggaggctcgtgaaatgctggtaaagtgggaggccaatgacccggaagtacgtgcgctctggaagaagatgaacgactgggtgtatgcaggttttgacgagacttaccgtatgatgggtgtaacttttgataagatatattacgaatcaaacacgtacctcgaaggtaaggagaaggtaatggagggcctggagaaaggcttcttctaccggaaagaagatggctctgtatgggcggacctcacgggggaggggctggaccacaagctgctgctgcgtgcggacggtacatccgtctacatgacgcaggatataggtactgccaaactccgttttgcagattatcccatcgacaagatgatttatgtggtaggcaacgaacagaattaccatttccaggtattgtccatcctgctcgacaaactgggcttcgaatggggtaaagggttggtgcacttctcttacggtatggtggaacttcccgagggcaagatgaagagccgcgaaggtaccgtggttgatgctgacgacctgatggcggagatgattgatacagccaaagaaaccagcaatgaactgggtaagctggatggtctgacaaaggaagaggcagacaatatcgcccgtatcgttggtctgggtgccttaaagtacttcatcctgaaagtggatgcccgcaagaacatgacattcaatccaaaagagtccatcgactttaatggtaatacggggccgttcatccaatatacttatgcacgtatccagtctgttctccgcaaggcaaaagaggcaggtatcgaaattcctgcccagttgcctgccggcattgaactgagtgagaaggaagaggggctgatacagatggttgccgactttgccgctattgtgaagcaggcaggtgaggactacagtccgtccatcattgcaaactatacgtatgaccttgtgaaggaatataatcagttctaccatgacttcagcattttgcgtgaggagaacgaagcagtgaaggtattccgccttgcattgtccgagaatgtagccaaggtggtacgcttaggtatgggcttattgggaattgaggtacctgacagaatgtaagcaccgcactataataaagaataagcccgaagatacttcttcgggcttattctttatatacttgtgatagaaatttgttttgtggcgtacattgtaattttcttcattatagtagtcaagatagataagtgtttatttgatggaagtgacggaaggacctcctcctccagtggggaaaccataaatatcgtaaattgctactatatcaatataactaaggttgtttctttgtgcattaaatgtcgaaccatctttcttggtcattgtaggcttcgagtaatcaatagcaaaagaattataagaaggatatagcattatagatttataatcaaatagtacatcaggaatgtacttaatcacggcgtgactttcttcccatatcttgaaattactttttttatcagactgaatattgtcccaatttatattaatatattcgtctctgtcgcgtcgttgctgctcatgaattaatccaagtgcatgtcctatttcgtgtaaagcagtacctttattactgtcatatttgctaatgctaagaatttgttctccacctctcattccgactgatgaataattaccatctccattgatgaacttgatgtaatttttttgagatgttctttctgtgaatgtgatgattttagaagttgattgtttccattcatccatggcttgttgaatatgttctttagtcgtttttgatattgcagagtcaaatttgtaataaacaatcccattgggccatttaaagtctggattattaacgattccgcctctggtctgagtaggattattaaaagaattaaacatcttttcggatattatcatatctcctccccaaataattaaatcattatacctttcgaatgatattccattttgcaaagtcacagtttctttagtcttattaggaaatgcttcttctaaattaattacatcaataggaattgtatttaaagaagaggtttcttcttttagctcatttgtacaagctaataaagaaagtaaaaaaatacagtttgaaaaaatgattttctttttcatgattttcgttttttaatgaagtatggtatgttagtttactactctactttcatttttgaaattgtatttaataatttgtattcaaatgaaggagcgtctacaatgtattctggcttttcaatttttgtttttaataggcttaacttatattcgtatccttcttggtatgtaaattctttaattgcatttagagaaagtaatactatttcattactgttttcctctaataattgcatttttttgttttcattaagcgtaatagggtctactgtatttacagtttttgaaagtatagtggcaataactaaactttcttgtagcttatcattttcgcattgtacaaaaatacaatatgctatgtatattaatagtgtgagtaagattttcttcatttcaaatttaattagagatgtagataattgggcgtttttgagttctcgtttattgtttttttaattcaaactattttcatgtttgattctattagtagatttcaaaatagccgtaatattcctcttttccgtcattcaactctaaaatataaattccttcttttgcacctcctatagaaaaagcataggattgctgggaagagagagaaatgaactctgaagaaatgatgtttcctttttcgtctttgacggtcacttgaagttcctttatggagacatcggattgtagatagatggtattgccttcgtggttggccgttggttctgtgactaaagaacgcgtttgggcgtttttttgctttctctctaaatatattttcgtcttagctgaacataatcctatgtaaagaaggcaagaacaaataataataagcaaacgtttcataatttgatgtatttgagttttagtttgcgaatttatgggatttcaatttgtttctcatttaagaactgtgcggtttttgtgcggttcttgttttgacgtgctattttgtgcgatttttgtgtgtataactgtacctttttatataggcatctataacgactgaataattttgtcccattgttccggtttgccaacttccccgtgtgtcttttcatacagctttttgcgggcagagacaatggctgatttagttcttctggtaagctgtgcgatacctgttacgttgattcctattttgagtaataggcagattttcatttcaatgtcgcttacggggtagatggcttgcaggcgtgctgtgaaatctttatagcaacgatccactttgatgcgtagcatttcccagtcttgggcatcaataggtttattgtcgttagcggcatctttgaatttgcagtaaatatcggattggcgaaaggctatttcggctaaggattgttctttttggtctgcttctattttgcagttcatgtgaagtatctgctctttttgtgccaagagcagcttttgcatagcattgttgctctgattggttgtttgcaaatctttttccaatagcgctattttgtgcttattgtcttcaatgtattgtgtacttctttggtactgctcctctttttgccgtttcagctctttcaagctattctccaaacgggctttcttttgtttgtttgtgtaaaaataaataaggaagacaagcaccagaatacttaatgtcaagagtgaagataatatccagaactgttggcgggtactttggttttttaatcggttactttctttttcatgtagttgataattgtaaagtgactgcattttacggatactttcgctgtctgtaatgtttttgatggaatcggtcaattcattgtagtgctggaggtgatataaaatggaagagcaattggaatctctttctgagatttttgctaatccccaatgagcggcttgtagggcatagatattatcactcttcagcatgatattatagtagtgctgtgcagaatcaaatttccccatttcgtgatatgaagctgcaacggttgcatattgcgctgtttcttgtggtggtgtagaaagtatgaccgtttgcaatatggctttggctgaatcgtattgctttagttggatatatagatcaatgaagcgatagtgcatcatggttattgattctttatctttgttcttctcggcttgtgctagtgcaagtgtataatagtgtaaaatactgtcttgcttatcgaaagccatccaagttgtccctatattgcagaggttgacaattatacttctttcatctttggtcaatgcactataccgataagcttttttgtatgttttcatcgcctcttcatatactccctgataaaggaacaattctcccatttgactataaatcactttctgcaatcggtaatccgtacttccttccaacagttctgctgctttctgatagtagtctaatgcttgtggggcatctcctaagtcggcatatactcgcccggcatagtaatatgcttcgggtaaatgcgttttgtcttttttatcttcataataatgcagaacttccaggatgaggctgtcagaggtatgtgtaatataggctttgtctctggcctttatgttcagtagttggtaatatatctgtgtggctttgggttctgtagtgatactgtcacggagttgttccagcaataggcaggcactgtccggattactatataccaatttatctgccacttgcatagtatgaggatatggtttgttgttgcaggcatagaggcatagcagcaggagtgccgataaaaggttgatttgcttcatggtatattgtcttttttgcatcttgacggttgagttttacttatccatcttgcatgcacggcgaatatatgcaatatttaacgaagacacaaggcttttttacaaaaactggctaaaggagtgttttcctccattttatgtagataaatcttttccctcattttatgtgggtaaaataagaagttgataatcagtgcaactccactgcaaaactactgcacgccttttgcagcgccactgcaacactattgcagtgacactgcataagatatgcagtgatgttgcagtggcactattggctttctttatccgcatcatccgtgcctgaagaatcgggcatgcagagatgacaaataccgtgaaaactctggttgtacaaaaaagtatttaggtactctgaaccttgggcttctttcggattgtccgaaactcttccgatatgaaaggaagagtaaatcggcttcatcctatttcgtcttgctcgttttggcagttgctttggcggttgttttcgtagttttcgttgctttcaccgcctttgcagtccgcttagacttgcccgtatccttgtcgctttgcagtttcacaatttccagacaagcctgaaggttcaggtcttgagggatgatgtctttaggaatcttgtagttgctgcctttataagcgatgtaagggccatagcgtccattcaggatttccagttccggttcttcctcaaacttcttgatatgtttctgggcttctgcttcttgtttcttttgcaaaagttcaatagcttcttccagcgtaacagtcatcgggtccattgtcttgggtaatgaggcatacaagccgttgttctggatataaggtccgaaacgtcccgcacctacgactacattcttgccttcgtactctccgagagtacggggaagtttgaacagctccagcgcttcttccagcgtaatggtctcgatggacatttctttttttacctgggcgaaacggggcttttcctcatcttcggcagtacctatctgtgctactgggccgaaacgtccgatttttacagacacttgttttccgctgacggggtctgttcctagaatccgttcgcctgccttgtgggcggttttcgcggcaagcgtgttctccaccgaaggatggaatttcttatagaatgttttcagaatggcggtccattgcttgtcaccttcggctatttcgtcgaattgcttttcgacgctcgctgtgaagttgtagtcaaggatgtccgggaagtactctatcaggaagtcattgaccacaataccggtgtctgtcggcatcagttttgacttttcggctccggtgatttctgtatggttgttgtccgttatttcattaccctgcaggttaagcacattgtaggtgcgttcttcacctgctttttctccttttatcacgtattcgcgttgctggatggtggaaatggtaggagcataggtagacggacgtccgatacccagttcctccaatttgcgcacaaggcttgcttccgtgtagcggggagggtgttgggtgaaacgttcggtagcagtgataccttcatgttcgagcttctgtccttttttcagagggggcagtaggcgtgcctcatcttcctgggtttctacgtcatcatcgtatgattcgcggtagacacggaggaaaccgtcgaatttcaccacttcgccggttgcagtgaaagtctccgtctcgttgctgatagcaatggttacggttgtcttttccacttcggcatctgccatctgcgaggcgatggtacgtttccagatgaggtcgtacagctttctttcctgcggggtaccttctatcttggcattctccatataggtggggcggatagcttcgtgggcttcttgcgctcctttggtcttggtggcgaagtggcggttgtgtacgtaacgttcgcccatcaggttggagatggtttcacggctggcgttgacggcaagttcggaaaggttgacggagtcggtacgcatgtaggttatcaatccggattcgtacagacgttgcgccaccatcatggtctgtgccacggtgaatcccagtttgcgggcagcctcctgctgcaaggtagaggtggtgaacggggcggcgggagttttcttcagcggacgggtagtgatgtcgctgatggtaaacgtagctgctttacagctctccagcaatttccgggcttctgcctttgtcttgagccggtgcgccagttcggctttcatttccactgttttgccgtcagtgtccggaacgaggaatacggcggtaacacggtaggatgcttcggtttggaatgcatgtatctcgcgttcgcgctctacaatgagacggacggctacggactgtacacggcctgcagaaagggcaggtttcactttcttccacaataccggtgaaagttcaaaacctacgatacggtccaggatacgtcgggcttgctgggcatcgaccaggttgatgtcaatgtcacggggattttctatcgctttcaggatggcacctttggtgatttcatggaagacgatacgtctggtgtgttccggtttcagtttcagcacttcgtacaagtgccatgcgatggcttccccttcgcggtcctcatcggaagccagccatacggtttctgcctgctcggcttcttctttcaactgggttacgagtttctttttatccgccggtatctcgtaatgcggtttgaagtctttgtctacgtcaatactgaattcttttttcttcaaatcacgtatatggccgtagctggaaaggactttgaaatcttttccaaggaatttctcgatggtttttgctttcgccggagactcgactatgacaaggtttttctgcataaatttctgttttttagtgactcccgccactgaattcgcccgcaaaagtaggaaaaaaagattcttcccaccttataatataaggagaatttagcaaaaatgaccttttttgttcaaattagagcttcggcttgtgctacctctattaaaagaggaagcttactccacctaagaaactgagaccttctgaagggtatccccagtagtactggtaatctttgttcagcaagttgttcacgcgcgcatacacggagattcctttgaagagttcgtagctgccgtttagatagagattgctgacggggtctgccttgttgccctccacgccttggcgtgagatgtgctgatagccgatgccgacaagcagtggggagatggggcgtaccttgagattgagattgccttctacggccggtttgaaacttactacgacatcagaaccgtctgagtccgttgtccaatggcgatagacggcattggcggcgagatagaaaacatccttgtagttgtagctcaggtcggctccggcatagaggttcttggtgtcttctgtgaggaaaacattgcttatcccgtcggacttgacagtcggagtgtcaatcaggtcgtttttcaaatcttgatacccgccgtataggttgaaccacaatccgctgaccggacttgccttgaagccgatggctgcgttgagctgttcgtaggtattgtcaagctgctggtttgtaatgccataaggcgtaatggtttccagacggcggaaatcgttctgtagccgtcctcccttaccttgtgcgtagaggatgtagctgtccgagaagatgtattgtatttctacgtcgggagcggcgcggaacttcttgccgaagccgaaagccaggtcgacgtgtgcgccgagacgtattttccagtcgtcattctgaaagagatagtatggattgaagtctacgtcggtgtgattctcgaaacgtccgtcgctgtagaatgtattgtccatggcaaaagccatgccgatggtctgctcatcggagatggaaccggtgacatcggctttggtacgcacgatattttctttgatattgctcaccatgaggtcgtgttggcgctggtagaccaacaaactggtttcggcacggaattggagaggcatatcgtcgctcgtggaacttaccccgaaatgtacatcacccgaaacgaatttctgcttgttgctgacgaagtcgggcaggaagttgaaattgctttggttgaactttccggcaatattcaaatcgactttgctgaaggcatgtacataatccatggcagcatgggtacggtagtagaatgaattccacttcccgccattatccggcaagtccagtttgccatccatgccatccattgtgaatgtcaggttgaggcggtctttgggggataaagagaagaggtagttggcgcgtacatcgaggttaccgtagttaccgtatcccaagcgtacatatccgggcagcgctttcgcctgcgtctcttttccggtataggcttgcatgatacctgcggggatttgggttgccggcatcagggtggcgtcatattccaccgcctttttgctgacggtaggaggttccaccctgggaagcacgttcactttggaggcatccatgatgtccggattatattcttgttccacgactaccgtacggttcatggtggtgtcttggggttgtgtctgggcttgtgctcccaaagagagggagacaagcatagttcctgcgaggatatattgtatctttttcataatgtgctatatttcttacttcaatttctccagtctttcgttaatcatgcttgctatatcgtcgtcggcctggtagttctgctgcaggctcaataggtattggcgtgcatcgagcttcttgtccatggctacatatacatcagacagaaggatgaaactgcgtgccagccagtaggcatacggtgtgctttggtcgatgaaattaaggatttccttttctgcagaggcataattaccggcattgtaccattgtaatgccaccagatatttggcttcggctccataaagggtacgggtgtctttggccagcagctgaaggtcatccattgccttcttgtcggctttctggttgaggtatgccttggcacggtagtacaacgcctcgttccggagctccggagacagcttggcttcggcaagcaaggctgtggcggcgttgatgacttccgcatcatcatgcatcagtgctccacagcgcagtacaccgatagcgccaagctggcggcgctctgccgtggtggctttggcctgcaatttcttgtagtcggccaatgccaggtcatattgctggcggttgaacagaatttctccatgcatcagcaaagcctcttcagaatatgggttatcggggtattccagcagttttccggcatgttccaataccgcctcttcatctttctgctctttgcctatgacgcagaggtagtagtgtgcattcaggctgaaagcgcctcccggataactttgcagataacgggtgaagctctctttggcaggtgtggcttcgcctttcatatatactttttcggcagcgatgtaagtcagcgagtcttgctcactgggttcgaagcggatttctcccggcatctgggcggcaagggcggcaaactcgtccacgcggttggcatctacgtagatggacttcaagtcgcgcatggcaaggcgggcttcctcgcttccgggatattgggtgactacatgtttgtaggcttctatggcacggtcatagtcgtcgttctggtagtaaagcagaccgatttcggcggcggctttacggctgacgggactctcgggatacttgccgagcaattcgcggaaggcggcgatagcttgggggctgttgttgctctgtacgtaggagcgccctttttcgtaaagggcattgatggcataaggcgaattgggatatttgacggcaaggcggtccagtaaagtaacctttccggaatagtctttttgcaggccggctacaagggccagctgatagtaagagtagtctccggcaggtgttcccagactttctgcttttgtatagtattgcttggcctcgtcgaagcggcggacgtgcaggttgcagtcaccgatacggttgtaggcatctgccaatgcggtcgggttttcacctttctccagttggacaaagttgcggaaacggttctctgccgtcgaatagtctttctggtggaaagcgatgtagcccaggttatagtaggcaagggcaaacatttccgtatccctctgccgggtgagtgacagatattcgttgaaattgcgggcggcttctctcatccggttcaggcggtaataagactcgccgagccagtagagggcgtctgccttggtctggaggttgtattgtcccagcgtgacgctttggttgaagtaaccgatggcttgctcgaactgcgtgttggcaaaagactgggtcccgagttggaacagaatcttttgtttggcttccagaatggctttgctgggatgggagatacggtcgatggacttgagtgcggcatcatagctgcgtgtattcatgtatacttccaccaggtagttgctgactttctcggcataaggagagtttggaaattcgtttaggaatttctcaaagacggtcaccgattcgccgaaagcggaataggaggtctcgtgaatgcataaggcgtagttataggcggcttgttccttgattttcgggtcggcattggaagcggcagcctgctcgaaggccatacgtgccttggtcttgtcggccagttgcaggtaagccagtcccatgtgcaggtaggcattttgggagagagcgtcgttctcggtagtcacttcgccaaggatggcaggaacttgggaatacacgccgcattgataataggacatacccagcatgtagagggcatctcttctatgagtggcagattcggcattgtgctccaggtattgctcgaaggactttatggcttcgtgatatttcccgaaatggtattcggctgtaccgaggatgcggttcagctccgccgtgtgcgtgtagctcagaccgtcggggtgggccgacaaagcattttgcgctacaatttctgccttgtcgtactgtttcttcaacaagtagatttcggcgatgtaataggggaccaggttcttgtacttggcattgtcctgcagaggcaggaaaccgctgagcgcttcgtcataccgtccttgggtatatcggatataagagatgtagtaagcacagtccgctgaatatttcctgctggtactgcgcagggtctcgaaccagatggctgcttcctttacattgcccgtcttcagatagcaggtggcaaggcggtaggtcatgtcgtcacgctcctcggtacccagaaggtcgaggcgggcggagttgaacatggcgagggcatcgtcataattgccttcgaagaaataggaggaggcgattaatgcatagatgcggttggcatggggagtatcaggatattcgtccagaaaggcgcggagcaggtctatgcttttggggtctctgagctcgtatgcggcgcatacgagcatgtattccgcttcttgccgctcgccggtatcgggcagaggcttgccgtctgcattcatctggcgtacataggcttgcaacggggagatggcggcagcataggccttttgctggaacagcgtttgtccttcctggtagagtcgcttgggagaagtactcttctcgcttgtttgtgctgaggcgagtaaaggtgcgcaacagagtgctgtgcacaatattcgggagattttatgtttcatcttcttttgttagaataggtattttacaaaaatacgggttttaacccggaaatgttacacttgtttggcttttttaggatatataccataataggaacgaataatcattcacttttgttcttccgtatgtcttccaggaagatacccactcctttgcggatggagccgagtccgaactcttccgtacggatatcttttaaggggaggaagaagaggtctgccgcgtcgtccatcgcctcgaagtgcaaggtgtcctccaccgtacaacggaaaaacatatccagcgtgtgtacggggaagccggaatagatgtaaatattgggtagggagaagagatattcggcctttgccaccttcatgccggtttcttctcttacttcgcgggcaacgccttcctcaccggtctcggtcatgtcgatgaagcctccggggaggtccagcgtccctttggcaggctctttggcgcggcggcacaccaacagctcgtcgcgctcgttcagtatcaaggcgacggtggcggaagaggggttgaagtagtagacgaaaccgcagtcggcgcactgcttcgacttctcgttatgaacttcgaaatgggctgaaccgcatttcggacaatatttgaattgcgaaagtggatgttccatgatattttagcctttgtccgggggacaaagataatggaaaccaggtgtagaatgaaaggaacagagtgaatttttcgtatctttggcgactataaaaccatatcggatgaaagattttgctgccattgattttgaaacggccaacgaacagcgtaccagcgtttgtagtgtaggagtggttatcgtacgtgatggagagattgtggaccattattatagcctcatccgtcccgaaccggagtattacacttattggaatacccgcgtgcatggtctgacgttggcagatacccaggatgctcctatctttcccgttgtgtggcaggaaatagctccacgcattgaaggcttgccattggtagcgcacaacaaggcctttgatgaaagctgcctgaaagctgttttccgtacttactgcatggattatccggattatgagttttattgtactttgcaggcatcacgtcgtgctataaagggattgcctaactatcagttgcatacagtggctgtttgctgtggctatcagttggaacatcatcatcatgcgttggctgatgctgaggcttgtgcatggatagcgaaacaggtcatataaataaacagaggagacttgtcatgaagcctcctctgtggaattgtttgtttccttgataaaactctatcagtttatcctaatggattttcaccttggtcaccatcattgccgccgcctccgctttcgtttcctccgggattttcttcattgtccggcacgatttcagagccggttaccaatcgtgtgatgcccgattgtttcatcatgttcttcaaacgttgtcccggcacgaaaatcagtttctggcggtaaacgacatcagccgttacagactttgcatcctcctggcttttgccgttcaatcccggtcggaggcttccgaagtctcccagccgtacggttgcaccgatgctggcataggtgcagagtgcgtcaatcataccgtccaatacggcttttacgatacctcttggcaccatcccttgactggtcacctggtcgcataatctatcaaaatcaatatttgctacggaataagaagcagctacatacttctcggttttggtaccaatgcctaccattctcttttttactacataacgaaatgccataatgttttttgtttttaatggttgttacttgcggtttcgttcactcgtcagttagcgagacctgtttctttgtgaccacggtgcgaagttacaacacttaaaaacggcatggtgctttaacgggactgaacgactttttttaacgttgtatttagccatttgacgacatggaaagtcctatgttataacctattgcctatatttaaaaaaaatgagtgattacataaaataataattttgtgattctccatctgtaatcaagtacaatccattgtctgtaaacttgatgactttgggtttgaatgtgagtttcttcaatgcctctgccaaattggatggaatgtttttgtaatatactccgtttttgcagcaagctatcatcccgtaattggtaatataggcatagtaaacctcttcgtatagttcttcggctttcagtatgaaatttttgatggtttcatttgaatagctgtaatgcttgtccgtgataactacccattctcctctatcattgaagcaggccgaaagaatattgtcgtctcttaaatctcctgtacgatattgttccagttttttgaggaatgcatccggataaccaagagtccaataccctgaaccgcctaagataattacatagttgccattttcagtgatgttgatgtctgttatttcagcattgctgctgttggcttcttctatacgtttcttaagcttgctgggagtactgccggtgtaggcatatccactattcccatacactcctactcctgctccatacatagtgattgctccggtacggcatttcccccatttgttgatggcttctgtgatgtatgacatgtatgagctggtcggtaaatttatatagcgaacagtaccgctataggaaaatggttttgaaacggttctggttctgactggaagaaccggttccgctttttctttacagatataagaagtaccggctatcaattcatttccaatccattttcctgactgaatggtgtgtgccgtaatatcaaagtaagcgccgtatccatttctttcaccatccttccaagggccgaaccacatattcccattttcccagatatgaatgccgtatccgtggcgttgtccattataggtttctccccaatatttattcccgtttgtgtagtttgtccgttcaaatatttgtccgggatattctttggcttctatttcataactgtaggggcggagcagcatatacggttttccggtgtttcggttgtattctacaccattttcagagccatttttaactattatgtcatcttcttgaatatggatgaataaagtgaattctgagtttttagtaaagccaattttaatattatcttctttgaattctaccctgaatccatttatttcatcattttgggtttgtcctagagaagcctctccttctattgtttttccccactctaccgtgctattgcgaacagattcatgcatgcttttctgttcactttccgaaggtgcagtgtagaatggtttatagtccggtatcattttgaggagagtattctgtccgttgaatcccgcttcttccaatctttctatggcagcttctgctatagacttctggagttctccaatgtctttgttgagagcagcctttttgtaccaatataacgctgaattcccatcttttctcaagatgttgtctatgccgtattcataagagattgcaagcgaaatctgtccgcttgcattcccgtttttagctgctcgttttgtccatgccattccggcggggtaattctttgtgactcctaacccgtttttcagtaaataggctaagcggctttgtgcataataagattccgggctattattgtgttcggcggcttttttataccagataaaagcctcttcatagttttctttgtcttcatatatgcgtccaaggttcttttgtggaaaagccccatttttttcagctgcttttttataccaatagatggccgtttctttattttgagttaaattcccccagccattactataggctgcacccatattgttttgtgcagcaggatttccttgctcagccgactttcgccaccaataaacggcttgtatggtatcaggttttataccccatcccctaaagtagctctgtccgagatagaattgtgcaatcgcgtttccatttattgcatctgtcctatagtccgcagcattcttgtggttttgcccataaatactgatggtaaatactgcaaggaatatgcacaataagtaatttttcatgtttttcataaattaagagttaatcaattgcatccaataaaatgaatgcagcccagtaaaagggatccttatatttttttattttcttgaactctttgggcataggctttttgctctgtttttctttttgcctggcttctgactgccagcgcttgtcgggagttgtttcaatttcaacttcgtagtcacgtacatacttctgggcctcgcgcaaagattcaaatttgctctttcctgcgagcagattcttgtaaaactgtgtcatcaagagttgagtagcattatcgtccactttccagagactcattaataatgtgttggctcccgcttttttgaaaccgcgttgcaagccgaatactccgtcaccggttatttctcccagtccggtttggcaggcagaaagtactaccaggtctaaccctcgtaaatctaaaccggcaagctctttggcggtgagtatgccgtcttctaatccttccggcaaaggatttcctttcagtgcaatatttgctcctgacaatagcagtcctgatcgagtcaatgctttgtcttctacgtagcgtgattggttattgtctcccatcatcaagaaatcaagatcctttgtctgtctggcttctgtttctgtccaatagaaaccatgagtggcgatatgtagcatactgatattcttacctgataaagctttaaaagattcttctgtacctcgtaaatccatatataaggctggctgaagtctcgtattctctagtgcttgtttaatttgttcagcttctatcttagtggcgggaaggtatttggctccgtcacgcaggtttagggaatccggatagaaggtatgttgaatattcaagtctcgaggaatatcagtatattttttgttttcgactactaaagctgttgtatcagcatcatatttaagacctccatagagaacagcttctttaatatggcttttgtcttttatcataaccaattgtcgcgtagacgacaaccgatagaaatttatttgttccgctataaaagtagagtcgctgcttggaaggtgttctatggcgatgttatggagttgcccagcaggagcaaaataaatattctttctttgtttggaacggcaactttttattctcaactttgctcatttaagagtctgtttaaaaaccaactgaataaaagcttttattacgccaatgaacctattattagagcgatttttccccttttttaatccctacttccctttttattaatacctttgggcgttgtttttaattcgttagacagatgtcttctttccgttagacaattgttgttctttcgtaagatggacgtttaacgaaacagcaacaactgtctaacgaattaaactcggtgcatcaggacttgttcttgcagcattgaatgaataatattgcccaactgatattctaaattatatgagtgcttattacgatttataccagacccccaatccttctccggaggacggtgaagaaaagctgcttcacgcccgtattcttcccaaaggaaccattcctgccgataaattccgcgaactggttcacaaggctaccggtttcagccctgccattctcgatggcacgttgcaggctataacggatgagttgcacagctggctggcagacggatggatagttgaagtgggcgaattgggattcttttcgttatcattgaagtgcgacaaggccgtggcgaataaaaaggatattcgctctccgtccgtgcattttcagaatgtaaacttgcgtatcggcagtaaattccgcaaccgctttcagacgatggagctggaacggaaagcatctccctatatctctcattccaaattgacactggaggagcggagaaaaaaactgttgcagcatttgaataagtatggctgcattacgcgtactgattatgaacagctgaccggaaaggcgaaacatcaggcggtggccgatttgaacctatttctggaagaaggtattattcgcaaatatggtagtggaaaaacagtggtatatctcaagccatgacaagcaagagagttagaggagttatcactttgctccgctaggagttacagccgatactcttgtgtatgtattcacagaactatcggctttaactcctaagccgacttgccggctgatgactccttctgactcccgataactcctttaaacgaaagagccgtgcgtataaaaagggaagaaacttttagtactgccgatttgtttttaactttgtcaattgaaaactaataaaaacaagcgtatgaatatgaaggttgtatctatgtgcctgatatgtgccggagctttgttgaccggttgtggaaacggcggtaaaaaggaagcggaaacttcggagagaaaggaaaaagaggccgtggttggtagtgataaagacgaacatggttgtattgcttctgccggatatacgtggagcgaggtgcagaaagattgcatccgtttgtgggagaaaggtgtccgcatgaatgcagtggatgatgccgggaagactttgttcttggtgttcagtccggactctacgcaagtggagttgtttttctcggaggaaggtgtttcgaacgaaattctggaccgtcgaggtctgcctgccggtggatatgcctggaatgtggaagatgatgatacgaaaaacgtacgtctggaagacggtgagtggacggtcagccaacgggggaggctcatttatcaggaagatgcgaatggtaaataatataagaatatggaaaatttgaaggcgttgacagaggctgtctgctgtgtagcccgtgaagccgggcattttttgaaggaagagcggaaaagtttccgtcgggaggtggtgcaggaaaaacatgcgcacgattatgtatcttatgtggacaaggcttccgagaaaaaggttgtatctgcccttaggaaattgcttcccgaagccggattcattgccgaagaagggtctgctgcctatagtgacgaaacgtattgctgggtagtggatcctttggatgggacaacgaactatattcacgacaatgctccctattgtgtaagtattgccttgcgtgacaagcagtcgcttttgctgggtgtggtttatgaaccctgccgagacgagtgtttttatgcttggaaaggaggaggagcctatgtgaacggagaacggttgcgtgtttcgcttgtcagtgaaccgaaagacgcttttgtggtgacagagttaccctacaatttcgagcagtatgcccgtacgggcgaacatttgatacacgaactttacggtaaggttgcaggcattcgcatgaatggttcggcggcgcttgccctctgctatgtggctgccggacgttttgacgcttggctggaagcttttatcggtaagtgggatttctctgcggctgcactcatggtgttggaagccggcggtaaggtaacagactttttgggaaacgagaactttatagaagggcatcatatcatagccaccaacgggccgctgcatccgttgtttttgcggttggtacgggaggcgctgccattctgatacggttcttattgccttattacacttttttatggaaaacacatttaaagcctggttcttgtcctttgtccatctcttcttcccgcgtcagtgtgctgtatgcgggagctctttgcaagagggagaagagggcatttgcatcaggtgtaatatgaatatgccacggacaaactatcatcttcgcgaagacaactccgtggagcgtatgttttgggggaagatacctctggaacgcggcacttccttcttttattatcacaaaggaagtgatttccgccacatcctgcatcaactgaagtatggaggccggaaagatttgggagaaataatggggcgttttatggcagcggagctggcggctaccggttttttccgtggtatagacgtaattatccccgttcctctacatccccgcaaacaaaagttgcgcggatacaatcagagtgaatgtatagcgcgcggcgtttctgccgtaacgggtattcctattgatgtgtcctccgtgctgcgcagaagacatacggaaacgcagacccgaaagtctgcttacgagcgttgggaaaatgtagacggtattttccttctccgctatccggaacgctttgtggggaaacatatccttattgtggatgatgtactgaccaccggagccactacaactgcatgtgccgatgcgcttaaagatgtgggaggcgtacatgttagtatcctgacgctggcagtggcgggttcgtgaatcagaagcggaaacgtccgcctgccacgattgttcccgtatatcctacgccgaattcggtgaagaaggcaaactgatttccatattcgatacccagaaaactgaactgataggcaaattcctttttgtgataagtgtctcctccaaagctgttccggaggaaataggcgccgagccctgcagaggaatatagggagaattgggggcgggtgaaccaatgccaccggaaggtggggaggatatacagatagcgccggtcatcgttcttattctcatccaaaacttcataaaggctactggccgtccctctattaccggttattcctccggttacgcctaggctgattttacggttgattctataaatataactgatattcagagcgccgtaatagctggtcttctcgcgtgtatagattccaaaacttgctgtcggagcaataaactcttcggctatactattggcgtcggtaatggggaggaagccgtaactgacggatatttcatggtggcggaatttttctcgcgtagaaacaagagaggtttgtgctttaccagcggtacataggctgaatcctatgactaaaaagaataaaagagttttcattgtagtttggtgtttggattaaaatatgtttttctaataaataaagacaggtgcttttatgaaactccttactttacatttggcaaatgtatgttaaatctttgaatatgaaatagaaatgtttgtcttttgtgtgggataatgtgggaaaacaaaaaaggttcgcctaattgacgaacctttttgctcttcctcttggacttgaaccaaggaccctctgattaacagtcagatgctctaaccgactgagctaaggaagaatgttgttttttctcaaatgcgctgcaaaagtaataggatattttgaaatatgcaatatctttgcaaaaaaaatatcgaagatggataaaataattgggttgggcaatgctttggtcgatgcgctggcaatcattgaagatgataatattttgacggagatgcagcttccgaaaggaagcatgacgctgattgatgaagataagttcttgaaaattagtgagtatttcagccggatgaagacgcacttggctaacggaggttctgccggaaacgcaattcgggcaatggcatgccttggtgcgggtacgggattcatcggaaaagtaagcaatgacttttacggtaactttttccgggatagcctgctggaacgtgggacagaggcgaatttattgctttccactacccttccgtccggtgtagcctctactttcatttctcctgatggggagcgtactttcggcacttatttgggggcggcttctacattgaaggcggaagatctttcgctggatatgttcaaaggatatgcttacctatttatagaggggtatctggtgcaagaccatgatatgattctccgtgccattgagctggctaaagaggccggcttacaagtatgtttggacatggcgagctacaatatagtagaaggagaccttgaatttttctctctgttggtcaacaaatatgtggatattgtttttgccaatgaggaagaggcaaaggcctttacgggtaaggaaccggaggaagcattggacatcattgccaaaatgtgtagcatagccattgtaaaggtgggtgcccgtggttctctgattcgcaaaggtacagagatggtgcaggtacaagcggctccggtagagaaagtggtggacactacaggagctggcgactattttgcggcaggtttcttgtatggactgacgtgtggctactcgctggagaaatgtggcaagataggctcccttctctccaaagatgtgatacaagtggtgggtacggagcttcaggcagcacaatgggaaaaaatcaaggaagaaattttattaattaattaattaatgtgctgatgtgccaatgtgttaattggctgcgcaatatttgtttcgctattacgctgcaggttattagcacattggcacattggcatattagcacattatcataattatgagaagaattttaaagatacgctggatggttgccttgctgattgtagcgggagccatttgtttttgggggtttaagagtggtgatagccgtagtttccaaatagcaaagaatctggatatattcaattccattgtgaaagagttggatatgttttacgtggatacgattgatccgaacaagactatccgtgaaggcattgatgccatgctctactcgctggacccctacacggagtattatccggaagatgaccaaagcgaattggagcagatgctgaagaattcctatggtggtataggttctgtgattacttggaatccgaaactgaaacgttccatgatatctgagccatacgagaatatgcctgctgccgatgtaggcctgaaagccggagatattttgatggaaattgacggaaaagaccttgccggaaagaacaaccaggaagtcagcgagatgcttcgcggacaagtgggtaccagcttcaagctgaaagtgcaacgtcccggtacagagaaaccgttggatttcgacattgtgcgccgttccatccaattgccgttcataccttattatacggtgctggataataatataggttatatcaatctcagcaccttctcggggaatccttccaaggagttcaagcaggcttttctggacttgaagaagcgggggatgacttcgttggtgattgacttgcggaacaatggggggggcttgctggatgagtctatagagatagccaacttctttctgcctcgcggaaaaacacttgtgacgacaaagggtaagattaagcaagccagcaatacctacaagacattgcgtgaaccgttggatctggaaattcctttggctgttctggtcaatggcggaacggcttcttcgtcagaaatccttgcgggctctttgcaggaccttgaccgtgcggtcattatcggtaaccgtactttcggtaagggattggtgcagaccacccgtccgttaccatacggtggtaccatgaagctgacgacttccaaatattatattcccagcggccgttgtgtgcaggctatcgactacaagcaccggaatgaggacggcagtgtgggacgtattccggacagccttactaccgtgttccatacggctgccggacgtgaagtgcgggatggtggaggcgtgactccggacattgcggtgaagcaggagaagctgcccaacattctgttctatcttgtcaatgacaatcttattttcaattatgccacggactattgcctgaaacatcctaccatcccttcagcagagaagtttgaaattacagatgccgattatgcggacttcaagacgatggtgaaaaaggcggacttcaaatacgaccagcagacagagaagatgctgaagaacttgaaggagatggccgaatttgagggctatctgactgatgcttcgaaagagtttgaagcgctggagaaaaaattgtcgcataatctggaccgtgaccttgaccatttctccaaggacatcaagagcatgattgcggtagaaatcatcaaacgttattatttccagcgtggaagcattatccagcagttgaaagatgatgatgatttgaaagaggctgtaaagatactgactgctccggaaaaatacaaggaaatgttgagtgctccggcagtgacgtcaatgtctctgcaacaaagaaaggagacagccccggtttttctgagtaccgctacgagagcaaatgaacatgtttatgatgaaatagtataaggacattcttaagaggattcttttatttgctccttaatttataccggatagtctctgtataagccttttatgagcgactatccggttaagttgtttgtaaggtattaacttgttttatatttttgcaggtgaaaatgaaaacattgacaaggttatgaaacaattgaattctctgaaagtatggctgtctgtggtattgttgctttgcttctctctttccggacaagcccagttcctgcgcacttcctactttatggaaggaagtaaccagcgtatgcagctcaatccggccttgatgccgggacgcggttatctgaatattcccgtgataggttcgttgaatgctaccgtcaactccagttccctggggtatagggatattatggacattattgagaacagtgatgatagcgactatttcatgagcaatgactttatgaaccgactggatgctaccaataacttgaatgtgaatttgagtaccgacattctgtctgccgggtggtataaaggaaagaacttctggtcagtcaatgtggggttacgtaatgatatcggtgctgccataccgaaaaccatgttccagtttatgaataacatgagcagccgggagtttggtgacaatatttctgactatttgggtattaacgaaaccattaatggacagaagcttgagataaattcctatgcggaagtcggccttggttttgcaaggaatataacagaccggctggctgtaggcggtaaggtgaagatgctgttgggtattggtaacttaaagctgaacatcaaccggattcatgtggaaactccttctgtcggttcttcaggaatgacgagtaaagcttccattcaagtggatgcaactttggagaactcgtcaaagctgttagaacttcccgagaatgagagtggcgattatatcgatgaaatcgattttggcagtttcggttttgccggatatggtggggctattgatttgggagtatcttacaagttactggataaattgacactttctgcttcagttcttgatttgggttttatcaaatggtctaaatcgaataccagtatagcgcgagccaatgcagagcagacttatgatcttcttgacccggcctcgcagcaggagttcatgaatattgtgaacagcggcgagattcttaactatgacatgttgaagctcaagacggaggaggcttctgagaagagccgtacccgtggattgacttctacaatggttcttggtgctgaatatgccttattgaatgattggctggtagtgggtgccttgtataccggtcgttttgccaaaccgaaaactttgaatgagttgactttctctgcctgcatccgtccgacgaatgctttcaatgtagctgccagctattccgtacttcaaggagctggtaaaaccttcggtctggcattgaagctgggttccttctttgcaggaacagattatatgttctttggcaagaatacgaagaatgtcaatgcttacttgggggtttctattcctttgggaaaacagaaaacggctgaaaattaataaagtgagttatcagttgtcgcgggttatctttctataaaagaggataatctgcgattttgtttttacgaaaacgcaaaaagctttatctttgctggtaaatacctataaacagtactcatgagaattgcaataacgtttctcttgtttttggttttcagtagtttgctgcaagcttcacccatacctttttctcctatagtgaggaactattcggtgtcggattataatgccggtattcagaattgggccattgctcaagacgaaagaggagtgatgtatttcggtaataacagtgggctgttggaatttgatggaagtgcttggcggctgtatgaattaccgacaaaaggaattgtgcgtgctatatatatcagtgaagatggaagaatttatgtaggctcttacgaagaattcggttattttgtccgtactccttatgacactcttgaatatcattcattgaaaaataaggtgaaagattttgcgtttcataatgacgaaatctgggatattgcttgcgttcaaggagaaattgtatttcaatcattcggttctctctttttttataatggaaattcggtagaaggtattcgaatgaagaaccttccactgaatttgttccaggttggaaatactttttattctcaaagaataaacggtggactttatgtctttgccggtagggaaatgaaagaacttattcccagaaaagcatttggagatagtgatgtcctggccgggctcccttatgatgatgcggttttaatgtttacccgtaatcagggaggtttcctgtatcgagatgggagggtagaaaaatgggaaactgaatgtgatgatatattcaagaagcataccattaatcgtgcggtgatgaccaaagatagttgctacgttgttggcacaatatccgatggcatatatgcgttggataaaaagggaaagctgatttggaaggtcaatacggataataaactacagaacaatactgttttgagattgtattgtgatgatgacaacaatatatggacagctttggatgaaggtattgcctatatacacaacaattctttaatctattattatgaacctccatttcgtaaaataggcatggtatatgatgttttggtaagggaaaatgaagcttatattgcttctaatcaaggactttattggcttagggatggaaagactgaattagttccgggtttggaagaacaagcgtggttcgtcgatgaatggggaaaacagattttctgcgggcacaacaagggaactttccttatatcaggactgaaatcaaagctggcatctgatgtaaaaggagggatgtgtatggaaaaaattgaattgaaggaacaatcttttttgttggagggagcttatgcgcttctgaatttatatacggagactgcttcgggagagtattgctttactcggtccttacgtgggttcagtcacatgattcgtcatatagaagtggaccatcaagggaatatttgggcgaaacatttaaggaatggtttgtatcgctttcggattgattcggatatgaagcaggtaaaggatgtgcggaagtatgagagtttgggagaagtgaaaggtgggagttttactttgttcaaaatcaatggtcgggtagttttttctaatggggaatatttctatacttacgaagatatgactgattcgattgttccctatgaaacaatgaatgaacaattgatggaattgaagggaatcaagactgtgagtcatgcgaacggagattactattggtttgtgggcgacaggactgtgtatttggtgaagtgtgcgataaatactttcaatatcgaacttcggattccatattctttgtttgacggtctggctgtggaagaacgaggaagcgtggtttatgacaagagaaataatcattcctatctttgcttgaataatgctattgcccgtattgaaacagatagttcctcgttatataaatctcagactaggcgttctttatggatttcagagatgcaggttactgaggaattcagtgataaacggaaaacattggtcgtgcagtcgggagtcaaggtcgaacatgagtttaatacagtgagttttacattgtgctatccggtttataacgattatacttataaagtaagataccggttggaagggtattctgatcagtggatacccgatggacgcaatttgcagaaaaagtatgcccgtcttccttatggaagttatgtttttcgggcggagatatatgatactggtagagttttggcatcggtagagtttccctttgagattttgtctccgtggtatttgtcttattgggctgtgggaagctacattctgatagggttgtgcctgctggccttgctgcaatatattgtttatcgttttgtgaagaaaaagaaggatcgtgtgattgagcagcagcgtgtagcccatcaggcagagcttgaacggcaagagaagaagattatcgagttggaaaaggaacagcttgaggccgatttgcgttttaaaagcaaagaattgtccagcgtggtaatgatgaatatcgctcatcaggagtttttgaattcattgaaagaggagatacagaagcaaaagttgtcgggacagcatagtcgtaagaatttggataagcttctcgctttggttaacaataatatagtgtctgatgaagagagctggataatgtttcaagctaattttgaccgtatacatgaaaatttcttccggaatctgaaacttcaatatactgatttgacttcaggagatttacgcttttgtgcattgctccgcttgaatatgccgacaaaggagatagcgaagttgctcaacatttctacacgtggggttgatgctgcgagataccggttacgtaagaaattcaatttgcttccggaagaaagtttgactgatttccttataaattttaaatgactgttttacagtaaaatattaatggaggaagtactaatattgtacttcctcttttgttttttagtgatgggtgtacttttgttgtagtgcgggatgtggaggttgtcgcatgcttttcttttatttgcagcaaaataatatttctataaattaaaagcatgaaagacatgaagcatttacttttcaagttacaatcatttttagtcttgttggtgtttactgccgctagtgcgtatgcgcagaaatctccggtcgatatgaatcgtttcatcgacgatttaatgaagaagatgaccctggaagagaaaataggtcagttgaatctgccggttaccggtgagattacgaccggtcaggctaaaagtagtaatgtggccaaacgtattcgtgccggtgaagtgggcgggcttttcaatctgaaaggcgtggaacgtatccgcgatgtacagaagcaggcggttgaagaaagtcgtttgggtattcctctcttatttggtatggatgttattcatggatatgaaacggtgtttcccattcctttaggattatcgtgtacatgggatatgaaggcggttgaagaatcggcgcgtattgcagccattgagtccagcgccgacggtatttgctggacattcagtccgatggtggatatttgccgtgatgcccgttgggggcgtgtgtccgagggcaacggtgaagacccgtttctgggagcagccattgcgcaagccatggtacgtggttatcagggaaaggatatgagccgtaatgatgaaatcatggcttgtgtaaagcattttgccttgtatggtgccggtgaggcaggacgtgactataatacagtagatatgagtcatcagcgcatgttcaatgaatacatgttgccctatcaggcggcggttgatgccggtgtgggcagtgcgatggcctctttcaatgaggtcgatggcattcctgccactggaaacaagtggttgatgacggatatactgcgtaagcagtggggatttgacggctttgtggtgacagactatactggaattgctgagatgaccgaccacggtatgggcgatacgcagactgttgccgccttggcactgaatgcaggtgtggatatggatatggtgagcgatgcatttgtaggtacgctcaagaagtcattgacagaaggaaaagtgacagaagaagcaattaatgcggcttgtcgccgtattttggaagctaagtacaagttgggcttgttcgataatccttataaatactgtgatgtgaagcgtgccaagaagcaaatctttaccaaagagcatcgtgctgttgcgcgtaagattgcttcggagagcttggtgttgttgaagaacgagggtaatgtgcttccgctggccaaaaaaggcactattgctgtggtaggtccgttggcagacagccgcagtaatatgccgggtacttggagtgtggctgctgtattgaagaatgcaacttctttggctgaaggtttgaaggcggtagcaggcgataaagccgaaatattgactgcgaaaggctgtaatttgatgagtgatgccgaatatgagaaacgtgccactatgttcggacgttctttacaccgtgacaatcgttcggacaaggagttgctggacgaggctcttgccgtggctgccaaatcggatgttattgtggctgcgctcggtgagtcttcggaaatgagtggagagagcagttgccgcacgaatcttgaaatgaccgacacccaacgcatgctgttacaagaattattgaaaacaggaaaaccagtggtactggtactgtttaccggtcgtccgctggtactgaactgggagcaggcaaacgtgccggccattctgaatgtatggtttgcgggcagtgaggcaggttttgccatcggtgatgtactgtttggtgatgtgaatccgagtgggaagctgactacgactttcccgaagagcgtgggacagattcctttgttctacaaccacaagaacacgggccgccctcttgccgacggtgcatggttccagaaattccgcagcaactatatagacatagacaatgaaccgctttatccttttggtttcggcttgagctataccacattctcttatagcgacgtgtctttggacaagactagcatgacggataagggcgaactgactgctaccgtgactgtgaccaatacgggcaagagagacggtgcagaagtggttcaactttatattcgtgaccttgtgggaagtgtaacccgtccggtgaaagagttgaaaggctttgagaagattttcctgaaagccggtgaatctaaaaaagtatctttcaagattactcccgaattgctgaagttctacaactacaatcttgattttgtatgcgagtccggtgactttgaggtgatgattggcagaaatagccaggacgtaaagaaagcagcgttcaagttactctaactgattctcaagacggcaatatgcagcattcgagccactgcgttgagatggcattgttgctgcatattgtctacatcttcactgcaaacgttttgcagtatttgcttggtatataatctatcgtataatggcaatcggttatggaaatcttatggtcggctttgaggcagtgaaaggtatgacgttcttgaatatgggataaaaaacttcagaataggataaaagccccctttgcttttctatcttcttgctctatatatatgaatagtacctaaatatttattgtacttttatattccttataatctgtcgtttatgttatacagtagtagtaatgatgtacccctccggtgaactgtggtactcttgtggtagcttgttttttgacatatatcaacttctccggtatgtttgcaaaagaattttaaatcaatacaaaatgaagaaaaatctactaattacatgtgtgatgttattgtttgccattacttcgatggcacagaacaaaattacgatttcgggtgtcgttacggacaagacaggcgaaactgttatcggtgcttctgttcgtgtgaaagggcaggagagtaaaggtagtattactgatataaatggtaaatatcagattgttgatgtggcatctaatgctaccttgatttttagttatataggtatgcgtgagcaggagattgccgtaaatgggcgttcaactatcaatgtgaagatggaagaggacagccagctcattgatgaggtggttgtagttggttatggtagtgccaagaaacgcgacttgaccggttctatcgttactgtgaaagcggacgagattgcctctaagccttctaccaatccactggcatccatacagggtaaggttgccggtgtacaggtggtgaatacgggtcgtgcaggacaagaccctgaaatccgtgttcgcggtacgaactccattaacggtttcaaacccctttatgtggtagatggactgttcacggacaatatcaattatctgaacactgcggatattgaatctatggaaatcttgaaagacccttcttctttggctattttcggtgtgcgtggtgccaatggtgtaatcatcattactactaaaagggcaaaaatagggaagacgatggtcaacatcaactcttcagtgggttggaaggttatttatgaccgtgtaggtgtgacgaatgccgaagagtttaagatgctgtacaacgagcagttgatatctcaaggaagcgacccttatgattatactcaatggactggtaatactgattggcagaatgagatattccagacaggttttctgaccaataacaatgtgagcattacgggtgcaacggataagagtaagttttatttgggtttgggttacgtcatggaagaaggttccattaaaacggaaaagctcaataagtttaccgtaaacttgaacagtgaatatagcgtaaccgatttcctgcgttttggtttccagcttaatggagttcgtgccaagtatcctgatgcaaagggtgtggatggtgctttgaaggctgctcctattgctcctactcatgaccttgaatcgggactgatacatacgctgcccgacttccagcgtgcacaagtgtggaatcctcttattgaaacagagctgcgcggtgctcacaacaagtctgaaaactatcgcgtggcaggtaatgtgttcggagagatagatattctgaagaaccttacgttcaaagcaactttctctatggactatgcttccagtcagggacgttcatattctccgctgatttatgtttataatcccgatgtggagggggggaaagaacggttgactgaaagagaaagtgtgaaccaaagcaagtctacctctcttgctgcacagtctgactatgtgttgacttatctcggacagtttggcaatcatggattgacattgactgccggtcttacaaccaattacaatgagtcttccagtttgagtggtggacgcagccagcttgcgggctacggcattttggtgggcgacgacccggacagatggtggctctctaccatcgacgatgtatctacggcaactaatggcggttctcagagtgacagatttaccatgtcttatttgttcagagcattgtataactacaagaatcgttatttacttaatgcttctttccgtagggacggttcatctgttttctataagacaggtaatacttgggacaacttttactctttcggtgccggttgggtaatgaccgaagagaagtttatgcagaaccagaatgtaattaacttcttgaagttgaaaggctcttggggtgtgttgggtagccagaatactggttccagttatccggcatatgccaccattgttagttcgggttcagctgtgttcggtgacaatatcattgcgggtaaaggccccaacaaactgatttcacctactttgggatgggaacgtaattattcatgggaagtaggttttgacatgcatatgttcaatgatcgtttgcagctttctccggtttattataacaaaacaacaaaagatatgttgacttccattccgggtattgcaggtactgttcccggattacagaatgtgggtgagattcgcaatcgcggttttgaacttagtgcttcttggaacgacaagattggggaagattggagatatggattaggtgctaatttgagcactattgataacaaggtgctttcactggtaaacaaagactataatattatcagtggtccctcacgtgtttccgaaggttatccgattggctatttctatggttacaaggttgagggtgtatatcagaacgaagacgacatccgtttctctccgattaactcggttggctcggtaacaccgggtgacttgaaatttgctgatgttgacggtaatggcaaaattactgataatgaccgtacaatgataggtaatccaactcctgattttacttacggttttaatgttaatttgggatggaagaatctggacctgactgttgacatgatgggtgtttatggaaatgaaatttaccgtaattggggaagcagtagctatgcacaactgaattatcgcacagagcaattgaatcgttggcatggagagggcacttccaattgggagcccttgctcgacccttcacacaaaataaatcaggaggcttccacgtatttcatcgaagatggcagtttcttcagaatccgtaatatcgaattggggtataactttgacaaacgactgttgaatcgtatcaaggtacagtcactgcgtctttataccaatgtgcagaatcccaagacctggagccgtaatggaggatatactccggaagtgggcggaagtgctatttcgtttggtattgatggtggaggctatcctatgcctacagtttatacgattggttttaatttgactttctaaaattatatagagacagactatgaagaagatattttattatatagcatttttagcagtaagctttgcactaacttcgtgtgaggatatgtttgatagaaaaccgcttggacaacagacagaggatgatttgactggtggtacttatgaaacacaggtttttaatatgtatgccaagttgcgcggttttcatttgacaagcggcaatactgcattggcaatccacggtatgcgttctgaggacgcagagaaaggaagtacattgtccgatggagctgctaccggcaagatgttcgatgactttgaatatttggcaagtaatgggatgattaagagttattggaatgataactattcattgatacataaggtaaatgatttgcttgatgagatgagccaaaatccgtcattgacagaaggtgacctcgtcaataagggggaagctttgtttgtacgtgctttctgttatttcaaccttgtacgcgcttttggtgaagtgcctttgattgactttaaagtttatgatgcagctgaggcaaatgttccaaagtcttctgtggcaaagatatatgaattaatagattctgaccttacggaagccgaaaacagtctgcccagaacgtgggagcaactttatgtaggtcgtctcacttggggagctgctcgttctcttcatgcacgcacatacatgatgcgtaatgactgggggaatatgaaggctgccgctgaagaagtgattaactccggtttatataatctgaaaacaccttatgaagacatattccgagaaaaaggtgaaaactgtagtgaatctgtttttgaattgcaatgtacggcaacagaatcacaaccaggttctaatgacataggaagccagtttgcttccgttcagggtgtacgtggcgcaggcgagtggaatctcggttgggggcaacacaccgctactcaagaattggcagatgcttttgaagagggagatccgagaaaagacgaaactttgctttattttatacgcaacggcaaggacgatccagagtccatacctgctaacaagccttatggtgagaaacctatttcgaatgctgatgttatagctaaatactttaacaagaaggcatatacggacccggcgatgcgtttgaaattcacaaagggaggatattgggtaaatattcgtctgatacgttatgctgatgtggtattaatggcttccgaagctgcttgtgaattgggtgatttatcttctgcccgtaactatttggagatggtgcgcgctcgtgctcgtggcaataatatcggaattctaccggaagtgacgaccaacaaccagaatgaactgcgtgaggccattcgtcatgaaagacgtgttgagttaggtatggagttcgaccgtttctacgacttggttcgttggggtattgctaaagaggtacttcatgcggtaggcaagaccggctatcaagacagacatgctttgttgcccattccgcaagacgaaattgacaagtcgaatggtgtattggttcaaaatcccaattattaatctataaatgtactaactacttatgaaaaaatatatagtatctgtggcttcttgcctgtttgcattgtgtatgcagtcttgttttcaggatatggatcatcctgctttcgactaccctgagagtacaggtgaagtacctactacccctttgaagatgtatcttccttttgatgaagaggacattcgggataaaggtgaatggggatttttggtagcagataacggtaatgccaagtttgcggaagacggaatcgctggcatggcctatcaaggtgctgagaatgcttacattttggccaagactccttctatattggaaaataacatgcccactatcggtgatttgactgtagctttctggatgagaaccactaagaatacttctgcgcaaggtttgttctctatccctaactctattaaattctggggcaacttcgacatcttcttggagaataataatagcgagactcaggcatttttcaaggttcatatcttcaatcagacagcaaaagagaatgatgaaagatgggttgaggcaaaaatagatgatatttttggtagcgaatgggtgcatctggcttttgtgtatgatggcaatacttctaccattactgtttatcgtaatggtgagggtgtctttaccaaagaattgccagattgtgggaaattgaagtttaataatgtaggcgcttctttggctgttggtgcatttcagttcagcactactccgagtcttacttcgggtgcaggagcacaaacctgggcaaagaactttcccggtcagcttgatcagttccgcttatatgacaaggtgttgacggcaaccgaaattcagagtatttactctggaaaagaatgaagctacactttaatctgatgataggatgaaagtattatatttcatagtatgtcttttgttggttgcgtgcagtggtgataatcaacctgaagtgaatcagcctttcgagttgaagaatatcattgtgggtgaccaacaaaaccaacagacatttgagaatgttgctcccaatgtagccattgttttggagttctcggatgctgtagatgaggcttcagcccgtaacaatattgctttgaaacatgaggagcttcctgtaagctgcgattatgagttcctgcaagagaaaaaagtatcggtgactcctaagggaggctttaaagtcttgtcatcgtataaattgattgtcaatccgggggtgaaatccacttccgggacactgctttccaatggcaaggtttgtatgattaagacaggaatggatgatacagacaagtttgagcgtatccctgatgaggacttgttgacattggtacagaagcagacctttaagtacttctgggactttgggcatgaatattccggaatggcgcgcgaacgtactacttcgggcgatgtcgttactaccggtggtaccggctttggcgtgatggccatgctggtagctgctgaacggggctttattacccgtcagcaagctgttgaacgagtgcagaagatagttacttttcttgataaggaatgtacggcttatcatggtgcttatgcacattggataaatggcgcaacgggagcaaccaaacctttcagtgagaaagacaacggtgccgatttggttgagacatccttgttatttcaaggtttgcttgccgctcgagcctatttcaaggaaaatacggaagtagaaagcaggttgcgtgccgacataacccgtctttgggaagctattgactggacttggttccggaaaaatggtgaagatgtactatattggcattggagtcccgattacggttttgagaagaacctggcaataagaggatggaatgagtgtctgattacttatatacttgctgcttcgtctccaacacatgctatcgataaagttgtatatgaagcgggctgggctaaaaatggaggaatcaggaatggaaaatcttattatggcatcactcttcctttaggttcggataaagggggaccgctgttcttatctcaatattcttttctaggcattaacccacaaggactggaagaccaatatgccgattactggatgcaaaatcgcaatcatacgttgattaattacaattattgtaaggaaaatcctaaaggatatacgggttatagcgcttcttgttgggggttgacggcaagtgacggcgatacgggatattcagctcattcacctactaatgataaaggggtcattgctccaacagctgctttgtctgcatttccttatactccggaggagtcaatggaagcgctgcatttcttctattataagataggagacaaactttggaaagattatggttttatagatgcctttaatttgacggcagattggtacgatactcagtacatagccattgaccaagggccgataatctgtatgatagagaattatagaacaagtctcctttggaatttatttatgtctataccggaaatccaacaaggactgaagaagcttggctttcagagtccgtgcttaaactaaaagaatgattatgatgagaatattaatatatttgatacttttgctatacccttttaatttgatttcgggacagaaaaagcagaagcggctttctgacgacgaacttatgaccctcgttcagaagcaaactttccgttacttttgggattttgcccatcctgaatccggattggcgcatgaacggagtaacggtggtgccgagacagctaccattggtgggtcgggattcggagtgatggctatcattgtcggcatagaacgcgggtttatcacccgtgaacaaggtgctgaacgtatactgaagattgttcgtttcttgagcgacaagaataccgacagttatcacggcatgtgggcacattggatgaacggtaaaaccggtaagaccattcctttcagccgtaaggatgatggagccgatattgtagaatccgctttcatgttcgaaggtttgttggctgcccatcagtattttataaaggataatccgacggaaaaccgtatccggggaatgattaataatctgtggcgccaagcagagtggaattttttcactcaggggcaagatgtgatgtattggcattggtcaccctataacgggtgggcgatgaaccatcagattaaaggtcataacgagtgccacattatttatattttaggtgcgtcttctcctacttatccgattgccgagagtgtttatcataaaggctgggtcaatgcgaatacttttctgaatggtcgggagtattatggcatcaggcttcctctcggaaacgataacggtaagggcggtcctttgttctttactcattactcttacatggggcttgatccgcatggcttgaaggaccgctatgctgactacgaggaacaaatgaaggcccataccttgattaaccgtgcctattgtatcgacaatccgaagggatataagggttacggtgagaaatgctggggattgacagccagtgacggtgataaaggctattcggcccatagccccggaaatgatcgcggcgtgattacgcctactgcggccctttcatccatcccttatacaccggaatattctttggaggccatgcgctatttctatgaagaactgggtgaccgtctttggggtgaatatgggttcaaagatgcatttaatctgactgaggattggtttgcgccttcgtatcttgccattgaccagggaccgattattgtgatgatagagaactatcgcaccggtttaatttggaagcttttcatgagtcatcccgatgtacagaagggattgaagagattaggctttacgtctccttatttgaataaggctgattaggtttggcaggatttgattttggtaaattttatatagattaaaaaggattataaccatgaaaaacgtgcttttcaatagtgtattggttgctttcgtattgcttgtcgcctcgtgcggcaagcaaccggaagctaaggtggaggtgatgtcgtttaatatccgtctggatcatgtagcggacagtatgaataactggaaataccgtaaggataatgcagcacagatgattgcttattatgctccggacattgtgggcatgcaggaggtggtaaagaatcaactcaatgacttgaaggagcgtcttcctcaatatactgcccttggcgtaggtcgtgcagatggaaaagagaaaggcgaatattgctcccttttttataagacagagcgttttgagcttttaaagaacggagatttcggactgagtgagactcccgattccatcggaaagaaaggctgggatgcggcatgcgagcgtatcgtgacttgggctgtgttgaaagacaaggtgagtggcaggaaagtagctgctttcaacacccactttgaccatgtaggtgaggtggcacgtcgagaaagcgctaagttaatactcgagaagataaagcaaatagcgggagagcttccggtaattatcactggagactttaatggaacggtagactccgagccggtcactatattgacggaaggtggaatgaggaacgcttgttccacggcaaaggtcgtttacggaccgacatggagctttcatgacttcggacgtattccggtggagaagcgcaggctgatagattttatattcgtaaatgcttctgtagaggtggagcgttaccgcacagttggcgataagccggacaatggctatctttccgaccatgctcccgtattggttactttgaaactgtaaagaggcactcgtctaattctattctgcattatttacaaatcataagggctcaagaaacacttgtatactgaacttgattcagtcgtatagtgaatgccattcagtcgtatactgaatagggttcagtcgtatactgaatgcactgtattctaactgtactgataatcagtaaattataaaacggtgttacgcctttgataaattacaacaaataatgaatacatgaaaaataaactatcctggggaattgccttgttgccctttgttccttcggtttggatgcaaggacaagaacagaaacaaggaataggaaacaggcgtcctaacattatttttatcatgagtgatgaccatgcccgacaagcaatgagtatatatggacatcccataggtaaaatagctcctactccccatattgaccgtattgggcatgaaggggcggtatttcagaataattactgttgcaattccatttccggtcccagtcgtgcagccatactgactggtaagcatagtcataagaatggttttatgaggaatggaaataaaggatttgacggttcgcagcagacactgccgaagatattgcaagcaaacggttatgaaacagccattatcggcaagtggcatcttgtttcaaagcctaccgggtttgaccattggatgattttgaatgatcagggagattattataatccgtattttattaccgagggagataccactcggcataaaggatatgtaactgacctcatcactcaatattgtgaagactggatgagtgggcgcgaggataagaataaaccttttttcctgatgatgcatcacaaagccattcaccgtaattgggtgcctgccgaacggcattatcatttgtacgaacacacgcagttccctttacccgacaattattatgatgcatacgaaggacgttatgcggcacaaatgcagaagatgaatatataccgtgatatgtacgaaggtcacgacttgaagatggttgcgggtatgaatagcgacagtctgctattcgacccgtggcctcatgcttttcttggtacgatggagccggatgagcgccgccgttttatggatgcctatcgtgaacggaacaatgaattttattcgaaacagcgtactttcaaagaggtggcagaatggaaatatcagcgttatttgcaggattatatggcttgtgtggcaagcgtggacgagagtgtaggagaaatattggattatttgaagcgtaccggattggataaaaatacgattgtcgtttatactacagaccaggggttctatctgggcgagcacggttggtttgataaacgttttatgtacgaggagtctttcggtatgccgatggtaatgagctggccgggacatattaagcctggaacgcaggtaacaggattaactcaaaatattgatttcgctcccacttttctcgatatgtgtggaattgagattcctgaagacatgcagggagtgtcatttcgtcggttggtagagggagaaaatactccacgaaactggaggaagtcactttactatcactattatgaattccccggttttcatagtgtccgtgcacattacggtgtcaagatggagcgctataaattgatgcatttttatgtggatgacaagtgggaactttatgatttgaaggaggacccggcagaaatgcataatttgtatggtgaaaaagggatggagaaggttgctgcagaattgaaagcggaacttgcccgcctgcaggaagaatatgatgttcctgaatctctgtgtaaataatggtgcatatttcgtgatgtataaatgaatatttagaaatataaatgtggataatatgatgaaaagattaagtggtctggtgctgctgttgtgtttggcgaatttcctttctgcacaggacatgcgtatggatacttattgtaatcctttgaatatcgattacacgtatatgatttataattcggataagagtatctcctaccgttccggtgccgatcctgccgtggtggagtttcggggtgaatattatatgtttgtcacccgttcacacggttattggcgttccagggatttgctgaactgggagtttgtacgtccgggcaggaactggtatccgcaagggtgtaatgctccggcggcacataattacaaagattcggtactttatgtgaccggtgatccttccggttccatgagtatcctttatacggataatccggcttcaggaaactgggaagctgttccggcaattttgcataatctgcaagatcccgatttgtttattgacgatgacggtaaagcgtatatgttctggggttcttccaatgtgtatcctatcaggggaatggaactggacaagaagcggcgtttcatcaagaagggagaaacgaaagaactcttcaatttggatatgcctaaacatggctgggaacgtttcggtgaaaaccatacggatactgtattgggcggatatattgaggggccttggctgacgaagcataatgggaaatactatatgcaatacggtgctccgggaacggaattcaatgtctatgccgatggtgtttatgtggccgattatccgatggggccttatacttaccaaaagcataatccggtgtcctacaagccgggtggttatatgaacggtgccggacatggaagtaccgtgcttggtcctggggggcagtattggcattttgcttcgatgtcactctctatcaatgtgaattgggaacgtcgcctttgtatgtttccggcagggtttgataaagatggcattatgtatgtagatacccgtttcggagactatccccgttatgcacctgccgtaccgggcaaggctggacagttccgtggctggatgttgctctcgtatggcaagccggtgacggcttttactacaaaagacgaatttaaggcagatgccctaacggatgaactgactaaaactttttggcttgccgaggctaatgacgaacggcagtgggtgatgattgatttagagaaacctgctgatgtgtatgctgttcagataaactatcacgattatcaaagtaatatgtacggtcgctacgaaggactccatcaccgttatctcatcgaaggttctcttgatggtgagaattgggatatattggtggaccgtaaggaaagttatagggatactccgaatgattatgttgaactggcattacccaagtctgcccgttatatccgttataaaaatatagatataccgacaccgaatctggctatatctgaacttcgcgtctttggattgggtacggggaaggcaccgcaacaacccaaaaagttggtacttgaccgccaagcagaccgtcgtgacatctccatccgttgggaggctgtgaaaggtgcacaaggttacaacatactttggggcattgcaccggacaaactttacagctcttggatggtctatgataagactgatttattgatgaaaacccttactgctgatcaggattattatttttgtgtggaggctttcaatgaaaatggtgtatctttacgttcggaagttaaacatgtaaaataaataataagatgaaacgtataatcggcatcctttgtggattattctttttcttgttttcgtttgcacaagaaacctttcaaaaggaaacttatatctcttcccgtggagatacattgttgtatcgtttgttgcgtccagaggtgatgaaacctgatgaaaagtatcctttggtgcttttcctgcatggtgccggagagcgtggcaatgataatgagaaacaattggttcatggtgggcagatgtggcttaatcctgtaaaccgcgaaaagtatccggcgtttattttggctccgcagtgtcctgaaaccggatattgggcatatacggagcgcccttcatcttttgctccggcagatatgccgttggaagtgcctgtttctcctattttccgtacgttgaaagagttgttggatttctatctggccatgccgcagatagacaaagaccgtatctatgttatgggactttctatgggaggaatgggtacatttgacatggctgtccgctatccggagatttttgcggcagcaatacctatttgtggaacagtgaatccggcacggttgaaggctggcaaatcggtcaagttccgtatttttcatggagatgcggataatgtagtaactcctgaaggatcgcgtgcagcatatcgggccttgaaagctattggtgccgatgtggaatatattgaatttcctggttgtaatcatggtagttggaatccggctttcaactatcctgattttatggagtggctgtttaatcagaagaaaaaatgatgagaatattgtctgttatcggagcgctctttttagggggcgcttttttaacttcttgcaccacttccggtcgggtaagtacttttgtggtattgccggatacgcagacttatctggagcaatgtccggaggtcttcgattcgcaagtggactggttggttgccaaccgtaagaaaatagatgccgtgttccaagtgggagatttgacacaagataattctccggtggaatgggcatatatgcagaaagcttttcatcgtgtcagccaagcaggaataccttattctgtcgtatggggaaatcacgatattggcagtaaacccggtaagttttcggacatacataacactgcaatggccaacaagtattttcctctttccggctataagcggaagagctattggggaggtagtgcagatggaaagacattggataactatttcataaatttcaggtcgggcgataccgattggctggtcttgaatctggaattcgggccttctgatgaggctctgcaatgggccgattccatagtgggtattcatccggataagcttgtcatattgaatacacacgcctatttgtattgtgacagtacgttgcatgacgggaaagactggtggcgccctcaaggatatggcatcggcaaagagtctgggcgcacagtgaacgatggtgctggaatctgggagaaattgcttctcaaacatcgcaatgtgatagctgtcttttgtgggcatgtcttgaaaagcggagtcggcacgctggtctctatagggaaagagggaaataaagtgtatcagatgctggcaaactatcagcgtggtgtggaaggtagtagattgggaggtgaaggctacttacgtattgtaacttttaaccggaagacaagggagatagatgtgaaaacctattctacttggaataaagcctaccacccctccgaacatcataactttaagttcaaagaggtggactttgataaatatctacgctgaaatttttcagaaaatagattcctgtgtctgtgtggtcagcagttccaaagccttgatgcccataacggaattccctttctggttcagtcttgggctccatactgcgactgaataacgcagtggataaactgcagctatgccgcctcctacaccactttttccaggaaggcctactagataagagaactctccggcttcgtcataaaaaccacatgtttgcatgatggcattgatcctttttacctgagaggaggtcagagtgatgttttcgaacgcaaaggcttgtttatggttggcgaaaggtaaaaatgccttagacaaatcataacagctcatctctatggagcattgcaggaaatagaagcggagtacgcgttctatgtcattgtttatgttatgatgatatttcaacagattggtaattgccgcattcaggtagccgttttcgcgttcggatagggctacttcttcattataatcaatctggttgtttctgctgagtgaacggacaaaacggatatattcctcttttggatgctttaaatggctcaatagaatgtcggtcatcacaatggcgccggcattgataaatggatttcggggaatacctttttctacctctagttgcactagcgagttgaaagcagtgcccgagggttctttacccactcttttccatagattgtctccttcaaggcttaggcacatggcaagggaaaatactttcgaaatactttgtatggagaagccggtagtagcttctccatgcatgaaggtttcgccttgtatggtgtgaatgcacattccgaactggtccggattgattttggcgagtgccggaatgtaatcagcttgcttgccaatagtggcataaggctctatttcttgatgaatacctttcagtattttctgataatccatattatagttcttttatttctctatatagtcgccattgtccctaatgagttctatcagcttttccaccgcctcttcttcgggaatgttcttttcgatgcactccttcttcttgtagaggctgattttgcctcgtccggcgcctacatagccataatcagcatcggccatttctccggggccgttgacaatgcatcccatgattcctatcttgagtcctttcagatggccggtggctgccttgatacgggcaatggtactttccaggtcgtagagggtgcgtccgcagccggggcaagagatgtattcggtcttgctggtacgtacgcgtccggcttgcaggatgccgaaagcagtggcatccactactttgccgcttatggtttctccctggttgaagagaaggataccgtcacacagaccgtcgaagatgagtgctcccatatctgcagccgctttgatttgcagattttccagttcgctctctgcgtagtgctcaaagaagactaccgggttttttaggcctttcttcatcatctggtgtactagagcgcgttgttcgcccaaccggttgggatgattgctttgcgaaatcaatacgacttccggatgatacttcaggcaggcgatggcttcgtcattcaatcccatatacgtgatgaagaggaatttcaaggaagcgccacaactgcttaggaaaggaagctggtctcctttaaaggcgggccaggcattgtccggttttgtctcgctgttgctttgttccatccagacatcggcatcgatgatgcattgcatgccttccggaagttgtttagggatggaacgtcccgtatagatatagtccggcacgaattgcggattgaagtccatgtccccgtccaggcgtgcggcaatgaccacgggcagattgtctccgccgatattgtgtacggcggcagtctcgcggcgggtgggagagagataattgaattccggcacatctgctccggggatataaggatggtcgtggcgctgcacgatatagtccaccaatttgcgggctacggggatttccgcctccggagcttcgctcagggaaacccggatggtgtcacccaagccgtctgccagcagggcgccgatgcccaaggccgatttgatgcgtccgtcttctccgtctccggcttccgttacaccgagatgcagcgggaatcgcataccttcctgctccatgacggctgccagcaagcgtactgtctttaccatgaccactgtattggatgccttgatggaaatgaccacatccgtgaaattctcttgtacgcagatgcgcagaaactccatacaagattccaccatgccttccggtgtatcgccatagcgcgacatgatgcggtcggataatgaaccgtggttcacgccgatgcggatggcagtatggttctccttgcagatattaaggaaggggacaaagcggtcgtgtatcttctgcaactcctgggcatactcttcatcggtatactccagatgtttgaaagtacgtgctgcatccacatagtttcccggattgatgcgtactttttctacatactgtgctgccacgtccgctaccttcgggttgaagtgaatgtcggccacaagcggcaccatatatccgtcctggcgtaggcctatgttgatattcatcaggttttcagcctctttgatgccttgggccgtgaggcgtacatactctcctccggcgtcgacaatacgtttggcttgcgccacactggcttctgtgtcctgcgtagcggtgttcgtcatactttgtatgcggataggattggagccgcccataggggtggctccgatgtttacttctgatgtttcccgtcgggaatagttgaataaatccacggtaataagtgattagcgtttagtgataagggattagtgataagggattagtgactatatctcatcttactaatcccttatccttaatccctaatccctcaattggttttgtattcgtacttcacatccttcaagtcctcatttgccttgactattttctttttcagcccttctttataggcggcgaatgtttcagccaatgaggaatcgctcagtgccagcatctgtacggcaaggatggcagcgttcatggcaccattaatggcaacggtggctactggtatgcccggaggcatctggatgatggagtaaagggcgtctacgccatcgagtacagacccttttacgggaaccccgattaccggcagtgtggtattggcagcaatgacgccgggcagggcggcagccataccggcagcggcaataatcactttaatgccgcgttggcgggcattcttggcaaattcctccactgcttccggtgtgcggtgggcagagagagcgttcatttcgaacggtacatgcaggtcattgagcaattgcgcggctttctccataacggggaggtcggaagtgctacccatgatgatgctaacgattggagacatgaatctttaaattattaaagggttaattttataagggttagggattaacgattaggggttagggactgcgctatcattccgtccggtgctaatcgctaacccctaatcctttcatttcattcgtttatcagcgctttgtaggcttcggcatccagcaggctgtcgaagtcggcatcagcggcgggtttgattttgatgagccagccttcgccgtatgggtcctggtttaccagttccggctggtcggcaagggcttcgttttgctccagaatctcaccggttacgggcaggaagaggtctgatatggtttttactacttcgatggtaccgaacacttcgtcggcagccaatgtttcaccttcggtcgggatgtcgacaaacacaatgtcacccagttgctcttgtgcataatcggtaatacctacataggctacatcaccttccaggcgaatccattcgtgttctttggtgtactttacattagtcgggaaattcatgatcattagtttttaagggttgatactatgtaaattaaaagttgaaaattaaaaattaaacaaggctcttaaaagaggaagattcggaacagtatgttgctcagcgggtggagtaccagcaacgagcagataagccctacggcaaagcctcccataacttcgcccagggtgtggtgtcgcaggatgatgcgggcggtgcccaacacgccagccaccagtataaagaggcatagccaccatacgggattgtagctgaacaaggcactgaaagctaccagtccgccaattacggctccggcgcctgccatgtgttcgctcagtttccattttaagttgacaatgacgcagattatcatcactaccagggcggagagtatgataccggtcatgtaccacgggatattgagccggtgcatcatgagcaggcagaatacataagaagtgatggtcagaataaagggaatgtatctcctttttcgttccaccagttcttccggactgaaaccgttgattttgcggaagatgaagatagtcagtgtaggcatcaggatggtgaagcaatacaccacgcccaatactatcaacttgtactgcaacggcatgatgcgcaggtacgagaatataaacagaatcagaaatgccaggaaagggatggagaacggtgtgaatatcgccgaaatcactttcgctgttctgattaaagttttatctgctataatatgctcttccacaacctaattttatttacgatttgactatttacaatttactatttgaatgcactaatctttaaaccttaatccctaatcgctcatccttttctctcatcttctcagtcttgccacggggatattcatctgttggcgatactttgccaccgtgcggcgggctatgggatagcctttctccttcagcagctcggtcagttcgtcatcggtcagaggctttttcttgtcctcgttgtcaatgcactctttgagtatcttgcgtatttcgcgtacagacatctcttcgccgtcttcggttgtgtagccgtcgttgaagaagaacttcagcgggtagatgccgtagttggtctgtacatacttgctgttgctcacacgggagatggtcgagatgtccaacccggtgcgttcggcaacatctttcagaatcatggggcggagcaatgactcgtctccttcgaggaagaaaggacgttgcaggtctatgatggcctgcatggtagtcatcagcgtattctggcgttgcttcacggcgtcgatgaaaccttgtgcggcatccattttttgtttgaggaacatcatggcttcgcgggattccttggactggttggcccggttcttggtgtgttcttccaccatctcggtgaagtcgcggctcatgcgcagttccggcacgttgcggttgttcagtgtcacgttgatggtaccgtcgtcataagtgtctaccaggaagtcgggcacaatctgctgcatgttcttgccgatggcttcgccgagcgaggcaccgggacggggattcagcttgcagatttccttaacggcttgttgcagggtatcttcgctgatacctaatttctgcataatcttgtcccaatgcttgcgggtgaactcttcgtagcactgggtaagaatatcttcttctatatagtattgtggaggcgagggcatgggccgttgcgcttccttacgtcgaatctggatgagcaggcactcttgcagggtgcgggcgcccagaccggcggggtcaaagtcttgtataatcttcaatacttcttccagctcttcgggagaagcgtcgataccggcgtagatggcgagttcgtcgctgatactgtccagcgatttgcgcagcaggccatcgtcgtccagcgagccgatgagatattcggccagttcgcgctggtgcggagtcaagtcctgctcgccgagctgctggcgcaaggtttcatagaaagaggtggcgtcggagaaaggaatttcttctgcctgctcccctttgctgcggttgttctcctgcagcttgtagtcggggatatcgtcttcgttcagataatcgcttaaagaatcatagctagtgtctccaccatcttctgagccggtttccgcatcgggtgtgtcggggtattcgtcgccaggagtatcctccttaccctcttccagtgccggattttccagaagttcggcacgtacgcggtcctctagttccacggcgggaagttccagcagctttaccaccagaatttgttgcggcgacagcgtttgtatctgctgttgcgcttggatctgtacttgtcgggagccttgtgccatatttttataaattattcaatgcactcattgtgcatcttctttcagatatttaccgcaaaaatagtgaatagttcgataacacgaaacctctctgatgatatttaacaagaaaagagaaaacaaacttttgccaatagcttggcaaacttttgccatgcctatggcaagactttgccaacgcggtggcaaaactttgccaaaggcttgaaaaacgttggcaaaatagtcttctgattatgaactatatagattaatctcctttttgtattatcttctttcaaagattatctatatctttgtcctataactactaaaacaaggaatgttatgtttgctaaagaaacgtatgtgcagcgcagggcccagctgaaaaaaacgataggctccggagtgttactgtttttgggtaacgatgaacaaggtttgaactatgaggacaatactttccgttaccgccaggattccacttttctctactattttggcttgtcgtttgccgggctgtcagctctcatcgacatagatgaagataaagaaatcatttttggcgatgagctgaccatcgaccatattgtctggatgggtacccagcccacccttcacgaaaaggcttctgctgtgggaatttccgaaacccgtccttttgccgacatcgtcggttatctgcacaaggctgtacagaagggacagaccatccattatttgcccccttatcgtgccgagcataagttgaaactgatggactggctgggtgttcctccggcacgtcaggaagggtctgtaccgtttatccgtgcggtggtggcacagcgcaactacaagtcggcagaagaaatagcggaaatagaaaaggcatgcgacgtgactgctgacatgcacatcaccgcaatgaaggtgcttcgtccgggcatgtacgaatacgaggttgtggccgaaatgaaccgtatcgccgagatgaacaactgcgagctgtcttttgccacgattgctactgtcaacggccagaccctgcataaccactatcacggcaaccgggtgcaaccgggagacctcttcttgattgatgccggcgccgagctgccttcgggttactgtggtgacatgtcgtctaccgtgccggcggacaagacttttactccacgccagcgtgccgtttacgaaatccagaacgccatgcatctggagtctgttaaagcgcttcgcccgggcattccctatatgaaggtgtacgagctttccgcccaagtgatggtggaggggctgaaagagctggggttgatgaagggcaatgccgaagatgccgtgcgcgaaggggcgcatgccttgttttatccccatggactgggtcatatgatggggttggatgtgcacgatatggagaacctgggtgagctctgggtaggctatgacggtcagcccaagagtacgcagttcggccgcaagagccagcgtcttgccatccctctggaaccgggctttgtgcatacggttgagccgggcatctacttcatccccgagctgattgacttatggaaaggagagaagaagttcatggacttcatcaactacgataaggtggaagaataccgcaatttcggcggcatccgtaatgaggaggattatctgattaccgaaacgggagcacgtcgcttgggcaagaaaattccgttgacaccggaagaggtggaagcgttgcgttgacaaccacatccttaatatacacagagagccgtttgtcccgataatgccggtggcaagcggctctcaaatttaggggtcatacagattgtattatgtatggtttatgcgtgcagttccagtacgaaccgtgctcccttgttgtagctgctgtctagtgtcaagctgccgttcatcttggtggcaatcagtgagcagatggggagtcccaggccgtcgccttgcgtcaggtctttcacttcggtgaaaggcttgaagatgttttcgcgttgctcctcggggataccgcaaccggtgtcgctgatgatgaactggtgggtgtgcgcaccgcgtttcttgaagtccagccatatttttcctccggcaggggtgtactcggcggcgttttccaacaaatgcagcaagacgcgttccagttgctcagggttgattttcacattcaatttgggggcattcacggtcagggtgacatcttcttgtgtcattcctttgattttgtccatgatgccttcacagaaagtggagatattcttctcctgcacttcgtagggttcggacaaggtggtttccaattcggacagttcctggatatggttggagaatgcatgcagggcttttacgcccggcagtgaggcgtcgagcgtgtccagtgtcggttccatttgggcggaaatgttctggataaatttggttttcagctcattgtgctcattagcaatgctgatggccttcttctgtttacgggtgaggatgatgaaacgcagcaatacgatggcgccgaataccagtgcggcggcaaggatggcggcgagtatgcaaagcccgatgatgatgtactgcttggcgcttagggaatcatctttctcctggatagtggccaggctttcatcgtatttcttcttcagggcgttcagttcctcttgggcggtaagcgcctttacggagtcggtccagaggatatacttgtcgtatgtacgagccaccagtccggcattgtttgccttgcgggcaatgctgatgagagtcttgtagcattcgtctaccttggcgtagttcttctgttccttatattgccctatcaggcggttggtggcggcatcaccttgcgcattcataccgaaggtgtagtaatagttggcctgcgtataaagcaggtcgttgctcagagagtcgttgtgagaggctttggcggtctcttccagtttggtcagctgttccttggcgcgtgcgggatttttcaggttgatgtacatctgcaggcgttccttgttgatgcggaaacgtaggttgggcatggccttgcccgttttctgttcgccggttgccaccacttgctcggcaccgcgcagcagttcaaaagcttctttatagtaattctcccgatggtagagggcgctggcattgacgccgcattccactgcctgggcatacttgtcttgcgtggcaaaggcattgtaggcttgcaggaatagatagcgggctttgatatattcttttttcgtaagattttcttgtgcttgtttcatcaattcgtctgcacggttttgcgcatggagttgagtaaagatgcagaaagtcgctaagagaagtatcgaaataatttttttcatgtgtacgtttgttttatttgctcacaaagttagaataaaaacttagtatttgaagctgctgcctcctaaaaattctctcaataaggatgtcggtggaatttctttgtcctgcacgggggtgaaatatttgatgaatttcagcaaccggtaggcttctgcgtattccggacagttccgtggaacactggtaaggatgggctctgcgtggcagcggagcacggcaaattcgaacaagagggcggagttgaacatgacatcggcattttcctggtaggggaatatccatttgtcctcgccggcacgtacactgggccagcgtgaaatggtctcttgtgccgagtagccgcggtagttgaagtcgcggatgatgcggcgcagcaggcggttgtccgtggtgggaatccagttgtggtcgtccagcgagatggtggtcagggcggatacataaatcttatatttgctggcggcgggaatctgtggtgtcagttcagggttcagggcatggattccttccaggataaggatggtatgctcgtcgatgcgaagtttgtcgcccttgtactctttcttcccgaggttgaagttgaagcggggcagctccacttcttcgccacggagcaatgcctgcagctgggtgttgaagagttcgaggtcgagggcgtagagtgattcgtagtcgtagtttccgttttcgtcgcgtggggtgtcttcacggtctacgaagtagttgtccagcgagatgggatagggacgcaggccgttggtcatcaactgcacgctgagccgcttgctgaaagtcgtctttccggaggacgatggaccggagatgagtacgagcttcacccggtttccgttttcgccgcggtggtagatgtcgtcagctatttgggctatctttttctcctgcagggcttcggctacgttgatgaggtcggtggcatggcctgtctcgcaagccaggttgaagtcgcccacgttactcagccccatgatgtagttccagcgcaggtgttccttgaatacgtcgagcatcttctcctgtttcaccacttcttccagtacattcgggttctccttgttggggatacgcagcagcaggccgtcgtaatacttcacgatgtcgaacagccagatgaacccggtactgggcagcaggttgccgtagtagtagtctacggtgtcgcccaatgtgtaataataggtatatagcgagccggaggtttccagcagcttaaccttgtcgttcatgccccgttcgctaaagatacgcacagcctcggtggtgtggcattctacacgatggtaggggatgttttcggcgatgatttcctgcatccgtttcttgatggcggtcacatcttccagctctatggaacggccgatgcgcaagttacagaagtaacctttggataccggatgctctacgaacagttttccttccggaaacagctcgctgacagctttgtaaagaatgaagcagagggaacggacataggtgcgcatgcctgaggagtcacgtatgtcgagaaactctacatccttattgttgtatacacggaaattcagtccttcggaacggttgttgacttttgcactgactacctgataggggaaatttagattaaaaccgtaataaatatccaaaagtgagctccctatagggaattctttagaaatattattatttttgcaacaaatttgtaacatgtgtttcatgatgtctcgtttttagtgggttgacacgttaaatataggacattataacacgtgaaggaatgaaacaccttaaataattaaagatggaatattctttttatgattttttaaagctactcggctcattggcactgtttctttacggaatgaagattatgagtgaggggcttcaaaaatttgccggtgacagactgcggaaaatattgaccgcaatgacaaccaacagagtgaccggtgtgttgacgggcgtgctgattacagcacttgtacaatcttcctctgcaaccacggtgatggttgtaagttttgtcaatgcggggttgttaacgctttcacagtccataggtgtcataatgggtgctaatatcggtacgactgttacggcatggattatttcagctttaggtttcaaggtggacattgccgcctttgctcttcctcttcttgctttcggcattcctctcctcttctctcaaaaaagtaaccgcaagtctgtcggtgaatttattttcggtttctcattcttgttcatggggctttcctatttgaaaaacaatgctcctgacttgagccaaaatcctgatatgctgtcatttgtgcaggactataccgacatgggctttatctccatacttctttttgtgggtatcggtacggtgttgaccatgattgtgcaggcatctgcggcaactatggccattacgcttattatgtgcgccaacggctggattagtttcgaattgggggcagcactggttttgggagagaatatcggtacaaccatcacggcaaaccttgcggcgctgaccggtaatacgcaggcaaggcgggctgctttggcccacttggtgttcaatgtgtttggtgtgatatgggtgttgtgtcttttcaccccctttaccgaggctgtgtcatggttcgtagagaacgtgatgggtactaaagatccggctgtggccgtatccttcaagctttcggcattccatacttgcttcaatatctgcaacgtgctgatattgatatggttcgtgaagtttatcgaacgtacggtctgtgccattattccaatgaaggagcaggacgaggaatatcgcttgcgttttatctcgggcggtatgctttctacggcagagctgtccatcctgcaggcaagcaaggaaatacatctttttgccgaacgtacccgccgtatgttcggaatggtgcaggacttgctgcatacggagaaggatgatgatttcaacaaagtgttcagccgtgtggagaagtacgagaatatcagtgacagcatggagctggagattgccaattatctgaatcaagtgtccgaagggcgcctgagttcggaaagtaagttgcaaatacgtgccatgctgcgtgaagtgacggagatagagagcatcggcgacagctgctataacctggcacgtaccatcaaccgcaagcgccagaccaatcaggatttcaccgagaagcagtacgagcatatccatttcatgatgaagctgacggatgatgccttggagcagatgattgtcgtggtggaacatccggagcatgcaggcgcggatgtgaacaagtcctttaatttggagaacgaaatcaataattaccgcaatcagctgaagaaccagaatatcttggatgtgaacaacaaagaatatgattaccagatgggtgtttactatatggacatcattgcggaatgtgaaaagctgggcgactatgtggtgaatgtagtggaagccagcagcgatataaaagaaaagaaagcgtcttaggacgctttctcaaattcttctttgcctactccacacaaggggcaaacccaatcttcgggaaggtcttcgaaagatgttcccggttctattccattttcagggtcgcccaattcagggtcatagacataatcgcatacagtgcaaatgtacttttccataaatttcttttttaggtttattctcctataataacgtttaaaagccctttttgttctattgttgaacaaaaatagtttatttttgttctctattaaaacaacattttatgaaaatgaccgacaagctgttcagggcgattatgcggaatctgcacgcctatgtactgctgataaaccgcgacttcactgtattctacaccaattactacgatattaccggagctgtaaagcctgccgaaactggacgggtgggagatattctgcgctgtaacaatgccttgtcggcagcaggaggttgcggcactcacgatttgtgtgagcactgccccgtgcggaatgccatagagaatgcctttgtggtgcaaaagaacttcacggatttggcagctattctgaatcttagggatagcgaaggcagaactacggaatgcaatgcttatgtttccggcgagtatatggagattgaggaccgcgactgcatggtgattaccgtgcatgacattacccggctgaaacaagtggaagctgaattgaaactggcacgtgagaaggcagagaatgccgaccgctccaaatcggtgttcctggcgaatatgagccatgaaatccgtaccccgctgaacgcaattgtcggattctcggaattgctggcctctgcatcgacagacgaagagaagacacagttcctggaaattgtgcaaagtaacaatgaaatgctgcaacagctgattgctgatattctggacctctcgaagatagaagccggaacattggaatttgtgttctcggatgtggacatcaaccagatgatgtccgatttggaacaacagttccgtatgcgggtggccgagctgggtagtggagtgcagattgtccgggaggcttctgagaaggaatataccatgcatacagacagaaaccggcttgcacaagtgatatccaattttatgacgaataccctgaagttcacccaggaaggcagtattaccctcggattcagactctatgaggaaggtctctatttctacgtaaaagacacgggaaccggtattccccaggaaaagttgccacatgtttttgaacgtttcgtcaagctgaagcaggaaaagaacggtaccggactgggactctccatttgccagaccattgtccgcaaattggggggcgaaataggcgtggaatcggaagaaggggcaggttcgactttctggttcacattgccgtgggagcctgcaactagaccgaaactggtgagggaaaaagagaatcaatgacagtcaattaatcactaatcattatataggtattgttttcccggattattattgtatttttgcgttccaaaattaaacctaaagacttgcatgactgcaataaaggatgattattatcatgtcggactgaccgacgaacaagtgcggaagagccgcgacgaacatggagtaaatttattgacgcctcctaaacggccttccttatggaaattgtatctggagaagtttgaggaccccgtagtaagggtattgctggttgccgctctgttttctttgattatttccattgtagagaatgaatatgccgagactatcggcattatagtagccattctgctggctaccggtatcggtttcttctttgagtatgatgccggaaagaagtttgacctgctgaatgcagtgaacgaagaaactttggtgaaagtaattcgtaacggacatgtgcaggagattccccgtaaagatgtagtggtgggtgatatagtggtgctggaaaccggtgaagaggttccggcggacggtgaattgctggaagccatttccctgcaagtgaacgaatcgaatctgaccggtgagccggtagtgacgaaaactacagtagaagctgactttgacgaagaggctacgtatgcttccaatcgcattttgcgcggtacaacggtggtggacggacatggcactatgcgtgtggaggctgtgggcgatgctacggaaatcggtaaagtggcacgtcaaagtaccgaacagaatacggaacctactccgctgaatattcagttgaccaaattggccaatctgattggaaagattggcttttccgtagcgggtctggcttttttcattttctttgtaaaggacgtggtactggtctatgacttttcttcatttcataccttccgtgattggctgccggccttgcaggctactttgcaatactttatgatggcggttaccctgattgtggtggctgtgcccgaaggcttgccgatgagcgtgacactcagtctggcgttgaatatgcgccgcatgctctccaccaacaacctggtgcgcaagatgcatgcatgcgagacgatgggagccattacagtgatttgtaccgacaagaccggtacattgacccaaaatctgatgcaggtgcatgaacccaatttctatggtttgaagaataacgggcagctggggaatgatgacctcagcaagctggtaatggaaggtatcagtgctaactctactgcttttctggaagaagaggtgactggcgagaagccgaaaggggtgggtaaccccacggaggtggcactgctgctttggctgaacagccaaggatgcgactatctggcgctgcgtgagaaagctacggttatcgaccagctgactttctctacggaaaggaaattcatggctaccctggtgcaatcccccctgattgggaagaaggtgctgtatgtgaagggagctcccgagattgttttgggtaaatgcaaggatgtcatgttggacggcaagcgtgtggatgcggtggaataccgttctacagtggaggctcagttgctcaactaccagaatatggctatgcgtacacttggctttgcattcaagattgtggatgatgcggaagcgtctgattgtgtgtcattggttgctgaaaatgacttgtcgttcctcggtgtggttgccatcagtgatcctatccgtccggatgtgcctgcggccgttgccaaatgccagtcggcaggtatcggcgtgaagattgtgacgggagatacaccgggtacagctaccgagatagcacgtcagattggtctgtggaaaccggaggatacggaaaagaaccgcattacgggagctgcatttgccgaattgacggatgaggaggcattggaccgtgtgatggacttgaagataatgtcgcgtgcacgccccacagacaaacagcgtctggtgcaactgttgcagcagaaaggtgcggtagtggctgtgacgggtgacggcacgaatgatgctcctgcgttgaaccatgcgcaagtgggactttcgatgggtactggaacctccgttgccaaggaggccagcgacatcacgttgctggatgactccttcaacagtataggtacggccgtgatgtggggacgttctctatataagaatatacagcgtttcattgtttttcaactgactatcaattttgtggctttgtttatcgttctcctgggttcactggtgggtacgacgcttcctttgaccgtcacgcagatgttgtgggtgaacctgattatggatacgtttgcggccctggccctggcgtccattccacccagtgagagcgtgatgaaggaaaaaccgcgtaagagtacggatttcattataaccaagtccatgaggtattacattctgggaatggggtctgccttcctggtgttacttatgggaatgctcttctggtttaacagtgaagagggggggatgactacctatcggttgactgtgttcttcacgttctttgttatgcttcagttctggaacttgttcaatgcacgtgtgttcgacacttcggactcggcgttcaagggcatttctaaatcttatggcatggagctgattatacttgccattttgggcggacagatactgattgtacagtttggtggagctgtattccgcacagtgccgctcgattttatgacttggatgacgattgtcgtttctacttcgtttgttttgtggataggtgaactggttcgccttatccgacgtttaacacagaaatagtgatgaaaagaagaggaatcaagaaccttattattgattttggcggagttctgattgatttggaccgccagcgctgtttagagaatttcagaaagctgggattgccggacgtggaagtcatgttggacctctatcaccagcaggatttcttccagaaatatgaaaaagggttgattaccagtgcggagttccgggaagtgattcgtggaaagatagggaaaccggtgactgatgcccagatagatgacgcctggaacagtttcctagtgagtattcctacttttaaattggatttactgttggaactgcgcaaaaaatatgtggtctatctgctgagcaacaccaatgaaatccattggcaatggtcgtgtctgcacgcgtttcgctacaaggctttccgtgcggaggacttttttgagcatatctatctctcttatgagatgaagatggcaaaaccggatgccgatatatttcagaaagtactggatgagaccggtattcttcccaacgagactcttttcattgacgattctgaggccaattgccggacagcggaggcgttgggtatttctacctatacgccaaaggcccacgaggattggagacatgcagttgttttgtgaaacatcggacattggttcccgtccaagtgtagccactatcggtttctttgacggagtacatcggggacaccgctacctgatagagcaagtgtgtgcggtagctgccgggcgtgggcttgcttcgtcggtcgtgacttttccggtacatccgcgtaaagtgatgcaggccgattatcatccgaagttattgaccacttgtgatgagaaagtttccctgcttgccaagactggggtggattattgcatgatgcttgattttactcctgaaatagcccggctttcggcacgggaattcatgtccatactgaaggatcgctatcagatacaagctttggtagtggggtacgaccatcgtttcgggcataaccgcagcgagggttttgaagactatgtgcactatggtcgcgaattgggtatggaggtgcttcttgcgcgcgcgtattcttatagtaaggagacatcggtaacggaggttactgtcagctcctcggctattcgcggtctgttgctggagggaaacgtttcggaagctgccgagtatctgggatatgatttctttttggacggtacggttgtcggtggctatcaggtggggcgtaagataggtttccctacggctaatctccgtgtttccgatcctgacaagctgattccctgcgatggtgtgtatgccgtccgtgtctgtgttgaaggcaaggagtacggcggtatgctaagcattggctaccggcctacgttggagaacggacccgatcgcagtattgaggtccatatattccggtttgatgctgatatttatcagcagccgatgcgtctttcctttgtgcgccgcacccgtcctgaactgaaattcgacagtatagaagaacttattgcccagcttcaccgtgacgaggtggagattaaatccattctttctttataaacataaggcgaggtcatttatccccttgcagttctatgtattttcccgtttgaagtgtttgttttctgtatatttatcgtaaaacgcgttttttttattgtttttcgataaatattttctgtttttctttgtcatatcaaaaaaaggccttttatttgcatatcgaaaaacgataaatgattatcgaaaaacaaaataaagaactaataaaacaataacggtatgaaaactttagtaatgacaacaatttttgtagtgacagtagtgataaatgcttttggtggtaatatccaggaaaactttgcctataatgaagtgatgaacggaaatcaggtggagtcccaaattgtatataaagtagagaacggtaagtttctgcagaaccatttgaaatacaatttcacctatgatgcccaagggcgtacgatacagaaggaggcgttgagatggaacgagattgagcaggcgtttgaacgcttctattgcttgaactacaattatacggaagccggtacggatgtggaatatgccttgtgggacaacaagacgaatgcctactccgatgtgaaggaaaaagctgtttatctgcaggcgggagatgacatcaactacttgagttacaaatggagtaagaaggacaacgactggaatctgttggtggaacatgccactgcggaggaagacgtattgctcctggcagtaaaataaatgaagaacaatatagaaatgagggaggggtttaggttatgagaagagcattcatgagtattacactattggtattgtcactttctacagtgatggtgctgctgatgggacttgttgccacagcttgacggattgacagagaaaatgtgtatctttgcgaacttttagacgaatagaacaatgaaaacggcaataaaactagtattgatttactttttgatgcagattgtaggagcactgtttgcaggacctttctgtctgctgtatacgtatttcgcttatggaactttcgacatggacaaggctggtcagattgctgtggcgcctaccatgctgctgggctttgttttcatgggactgtacttgtggcgcaagaactacctgacgggagacaagcatctgtattctccggtgtcagtcccttatctggcatggagcctgcttgccggaatgacttccatatgtataataggtcttctgatgtccgaacttacttttttgcccaatttgttggaccagacatttgatatactgcaatccggttggctgggtattctctgtatttctgttttgggacccgtactggaagaactgcttttccgtggtgccattaccaaggagctgcttcgcagatatagcccggcaaaggctatcttgttttccgggttgatatttggtatctttcatctgaatccggttcagataataggtgcttgcctcatcggtttcttgcttgcctggctttattataagacacggagtcttatggcatgtattctgatacatatcatgaataacggcttgtctgtctatctgagcctgaaacatcctgaaatggaggatgtgacacatctgctgagtaacccgtatgtactggtttgggcagtggttttcatattgttgcttctactctccttgaaacaactgaataaatataatatatctgatactaatacaacaactgaattatgaaaagaagattgaacattctctgcctggtggtaatgcttgtactgagttactcggtattggagcaggggtactatatctttctgggagccaagatgggggcgcagaccggactggagctgggaaagaaagggagtgacattgctgcctacaaggaactgatgaacctaaaggttgtcaacctgataccttcttccatggagtcgtttgatttcttcagggattccgtctacaatgagaaaagcaggagttatgtgcctgcagcctactcttcgttgatggtcagcgtagattctcatgattctgtcgggaaagtggtggcaaagtatttgctgatatatctgcatttgggcttttccctttgggcggtagtattgtttatccgcttgataatctctatcaacaagtccgacatcttcaactggcggaatgtacgtcggctgcgtcgattgggaatggcactggttgtcagcttctgctgtacctttgcgtcatcatatcttgattttataggtatcgataccgtattctcgctgcatggttacgagctgagcctctcagaattggtgagcactaccacgctggtacttgggctttgttcgctgattgtaggtgaagtgtttgccattggattgaaaatgaaggaagagcaggatttgacgatttaataataagaagaacggacagagatatgaataaaatcagagtatgtgccttcctggctttggtagtgtttattggtagtgttgtaacggatatgtttagtggatttatggacggctggaatgaggcgggcgaccagaaggattttcatgccttaccctctgtgtcacttttggtgcgggcagatgatacgctgcctgctgatactttgattagtgcggcacaggatacgcccatgtattgcaatacaagtgaggtatcggtgcaaggtttccgtagtacgaagtggcggtgggtatcgttcttgctgtttcctgcgggactgtttgcgctttacgggttctatagtgtggcgcggctggtgcttactgccacgaaaggcgaggtgtttgtgcacaagaatgtgcgtcggatgcgcatctttgtctatgcgctgatttcggtgagtcttttattcgagttgcagcaatggggcatctatcatgacttggcttctcaagtgcagctggagggatacgaggtgttgccttattctttcaagtatgcttggttcaattatatgctgttggcattgttcaccgagatattcgccatcggcgtgaagataaaggaagagcaggatttaacggtttaatgtggggggaggattatgaaaaagataagtatattgggtatcctggctatattggtcattgttgcagagtttacctatgcgatgatagcgggctgggtggatatgaagaatagttttcttgagggttacaatagtgtaaatgtgcattcgggaactccacagccggagtattccggtttatttgataaggtatatgtggatgtaagacctttggaaacgacagcagtcgattccttgacgaatcgttttgccgataagtcagtaccttatcaggtaaagagaataggcactgtgattgtccccactgtctggagttccatagtgaacttctttgccatgtttgccatcattcctttctttgtaggaatctattgtctgatacgtttgctggtatccatctcaaagcgggaagtgtttacttcggataatgtagcccggttgcgtttctttacttattcgtttgctgcattgtacggcttgatgactttgcacgattggctgaatcatcttgaagcagtgaagcaagtggctctgctgggctatgaagtggttgcatcgcatgatacggatttcacatccctggttattataattcttttcaccgagatatttgccgctggggtgaagataaaggaagaacaggacttgactatttaggtgtgagtgggaaaagaataattgataaatagaacacaattatatgattatagtaaaccttgacataatgatggcccgaagaaagatatctttgggcgaactggcggagaagattgatattacgcctgccaatctctctattctcaaaaccggaaaggctaaggccatccgtttctctacactggaagcaatctgtaaggaacttgattgccagccgggggatatactggagtttaaggagggataaatagggagaagaaggcgcaagtagaggttgaaatgcttaccgccttaagaaactccgtttacgtactacagtaaacacctttacatactacggtaaacgcctttacatactacggtaaacgcctttacatactatggtaaacgtcgttacttcatagtgtaaaagccgttacattctggagtaacggcttttacattatagggtaaacatccggtaaatataatctgctgattattagtttatatattgtcggtcgtaacctttagatgcctttcgctttgaaggccagcgcatacattcgcatctgctttaccatagacagcagtccgttgctacgggtgggcgacaagtgttccttcagtcctattttatcaatgaaatagaggtcggcattcagtatctcatccggtgtgtgcccggagagtactttgataagcagtgaaatgattcctttcacaatcagtgcgtcgctttcggcctggaaaataatttttccgtccacttcgtctgcctgcagccatacgcggctctggcaaccttcaatcaggttttgttccgtcttgtatttttcgtcgagcggttcctgctcgtttcctaaatcaataagaagttggtaccggtccatccaatcgtcgaaatcattgaattcggcaattacttcatcttgtacttcgttgatacttatcatgggatttactattttactatttacgatttactatttgatggtctatttctcattgtagatgacttccagcaaggtctgtcccactgcgttgagagtgcccttgtcgatgatgtccatggtgtcgtctatcgtgtgccagaagtcaccgaagccggtgtcgcagttggggtcatagttgatgatgtctacgcagggaatctgccgcaggttgtatacatacatatggtcgtctgtcacttcggtgcctttttctttggggaagaagttgccgaagcccaggcggtgggctgtgttccatatcttgttcacgtacttaccggcggttctttgagagaactgttccttgtagaaggtggcgttctttccgcctaccatgtcgagcaggatgccgtagcgggcattatagccgtctacatggggtactcgtccccaatattgcgagcccaggcaccaagtgtcgttcttgtatgcaccttgatagaagtaggggatgccatagtcttcggcgtcaaagaagatgatgtcgatgcctatggctggagcctgctgctgtagttggcgggccacttcgagcaatacgcccacaccgctggctccatcgttcacacccaggatggggctgtgatgcttcgtcttgtcggcatcctggtcggcataaggacggctgtcccaatgggcacagagcagtacacgccttttgctttccggattataggcgccgataacattgcgcgctttcaggatggtgttgtcgtaagccaccaggtcggcatgctggttgtatactttggcgccgaattcttccagcttcttggcaaggaattctccgcaggctttgtgggcggcggtgttgggcacgcgcggaccaaaatccgcttgggtctgtatgtattgatatgcactgtctgcactgaactgaggcacttggacagtcgctttggtcgcatcgccctcactgtcattatcggctgcagacttgctgctgttgttgctgcatgccactatcgctacaatcagcaacagcagcaacgggatgaatgtataattccgtttcattctctttctgtattaaaacttagtttcacttctttctttccaactttcagtgttaccgcagcgccgtttatcagcggtacattcatgctgacatgtccgacgggaaaatcgaaacatatcgggtaatcgtattccttcaccaaatcggccaatgcgccatataggtcttttcccagggacttgttctcctcgtattcggtgaattgtccgatgatgaggccggaaagcttgtcgaggacacctcccagtttgagattgtacatcatgcgttccaccgcatgtgggcgttctcccacatcttcgatgaagaggatggtgccttcggcgggaatatcgtaaggagtaccacgcagcccgtagaacacagacaaattgccgccgcgcaacacgccttttccctctcccttatgatttagtttgtgccccgggcagacataactgaatgcttcggttcctcccaatgcctgcccgaatagtatatccttcagtgcttgtgtgcagaagtcgtcttccggttctactgtgagatggcgcgccatgggggcgtgcaacgacgcgaagccattctgctggaacagattatggagggcggtgatgtcactgaatccgatgagccatttgggatgctgcctgaacttggtaaaatccagtttgcctatcagatgcacggctccgtaaccgccccgactacagaatatgactttggcttcttcatcgtccatggcttcctgcaggtcctcgaggcgttgccggatatttcctgcatacgttccgttggaactccccgcgtgctttgcgaatacgacttccagcccccaggacttcaaacgtttgtaggcgcctttcaggaaagatttgtcaatcttgctggaaggggagagaacaatgacacggtcaccttcctgcagatacggagggaaaataagactacccatatatattatcaatctattttgggcaaaagtacacaattcaccacagatatcacagattaacacggatttttaacagaagagagggaggttatatatgatatataatcaacagagtaactcaaattctgttcaaatccgtgtcaatctgtgtaatctgtggtgaacatatcaaaatgatattaaacatataaaatttcaatggggcaaatgccgtatttctcgacatttttttagatatttgctaaaaatctaacgttatggaaccgatacggaactttgcccagttaacagcccacctgaaaaccttgaataagaggaaacgtattgcggtagtctgtgccaatgaccctaatacagaatatgccatatcccgtgccttggaggaggggattgcggaatttctgatgattggcgattctgccatattggaaaaatatcccaccttgaagaaatatcctcaatatgtcagtaccttgcatatagaagattccgatgaggctgcacgtgaggcggtgcgtatcgtacgcgagggtggagcggacatcctgatgaaaggcatcatcaataccgacaatttgctacgtgccattctggacaaggaacatggtttgttgcctaaaggaaagattctgacccatctggccgtgatgcagatacctacttacgataaactgctctttttctccgatgctgcggtcattccccgcccgacactgcaacagcgcattgaaatgatttggtatgccatccatacttgccgccatttcgggatagagcagccacgcatcgcgctgattcattgcacggagaaggttagcgccaaattcccccattcattggactatgtgaatattgtagaactggcggaagccggagagttcggcaatgtcatcatcgacggcccgctggatgtgaagacctcttgtgagaagacgagcggtaacatcaaaggcattgtatcaccgattgacggggaggcggatgtgttgatattcccaaacatcgaatcgggcaatgctttttataaggctgtatctctgttttctcatgccgatatggccgggttgctgcaaggaccctcatgtccggtggtattaccgtcgcgtagcgattccggtttgtccaaatattacagcattgccatggcttgcctgaccagcggggtgaaagaaccttgattgtaattagtaatttgtagttcgtaatttgtaaatcgtaatcaatgaaaatactggcagtaaatcccggttccacctcgacaaaaattgctgtctatgaggatgaaactccccgtctggtactcaacatccggcattcggtggaggagctttcccaatttccccgcatcatcgaccagttcgaattccgcaagcacttggtgctggaagcgctggaggccaatgacattccctttaagttcgatgccatcgtcggccgtgggggattgttgaaacccattcctggcggtgtgtatgccgtgaacgatgccatgttggacgatatgctccacgccatgcgtacccacgcctgcaacttaggttgtctgatagcccacgaacttgccgccatgctgcccggctgcccctctttcatagccgatcccggcgtggtggacgaactggacgatgtggcacgcatcaccggttcgcctctgatgcccagcatcaccatctggcacgccttgaaccagcgagccatcgcccggcgctatgctgccgagcgtagtgccctgcagcccgaagctcccgtgcattacgaagacctcaatctgattgtctgtcacttgggtggaggcgtttccgtaggagtccaccgccacggccgtgcggtggacgtgcccaatgccctcgacggtttcggtcctttttcgcccgaacgtgcaggtaccctgcccgccgggcaactgatagacctttgtcactcggggcgttacactaccgaagaactgaagaaacgtatttccggcaaggcgggacttgccgcccatttgggtactaccgacattcccgccatagagaggcgcatcgctgagggagacacccatgccgctttggtgcttgatgccatgatttaccgcattgccaaggagataggcggtgctgctgttgtgctttatggcaaggtggacgccattctgcttacgggaggtatggcacattccgagtacatcacttcgcggttgcaggagcgcgtgtctttccttgctcccgtccacgtctatcccggagaagacgaattggaagcattggtaatgaatgcgctgggagctttgcgtggagagcttccggtgcaggtttaccgataataatcatatcgcttttgttcttcatgaaagtgtcataactcaccacagattacacagattcacacagataaatatgtcagatatcaataaactaaaaaaatctgcgtgaatctgtgtaatctgtggtgagttatgacatatatggaatcccggtttacttaccgtaatcgtcgtacatcatcaacagatgtgaggagctccagctgaaatggggagctttcaggcgttcgccggtatgggttccgtagttctcgtggatgggagcaccctctttcagcccactcaggcggtcgaagacttgcagcgtatattcatctgccagccggttgtagccgtagttgcgcagtccgcggatggcaaagtaggtttggtccagccagatggggccacgccagtagccgtgcggattgtatttgggattgtcggcggcaatggtcgggaaggggatatacgtggagaactttgccgtatcttgaagcatgggcagcatgctgtccacttgcgcttgtgtggcaatccgggtccacaacggagtgtaggcttcgcagcccggctcttcgatgaatgaaccgtccttcaggcggcgatcgcagaagaagttgatgttcttgtcaaagaaatagtcggctacctggctactgtagtctggtgcgtcgaaaggtatcttcagcaggctggagaatttcttcagcagtttgcattccagtgccagataagcgttcaagtccacactctcctgatccatactccaggcatcctcgtagccttcgtttttcagcatcacggcgccgtcaaaacggatggcgttgtccatgccgctttcccaggcggcagcttccagtgttccgtcggtagcaccgtactcgcacatgccattgcggttgtggtcgcgcttctcgtaccaccatctataataggagagcagttgcggatacatctcggcaacgaaggcggtgtcacccgtatgggtaaatatttcatcgacagcccagcataccaagggaggcttgctgtcacgggcattgttctcggaggggtcggtgtagatacagtcgataatcatgccgtccggttgctggtagtcgaacatggctcggatgttgttcttggccagttcggggtcgaatttggcggttccggcactgaagcgccagctatcccatgcccaaaagccgacgaaatagcctacggcatggctcgggatgataccttcgtgaagcaatccaccgcggtgtgtccgccaattggagatgagcgtggtgacggctttcacggcgatacggtcatattcgggcttcatgtccttgcgcagtatcttggtgaggtaaccttcccaacgttcggcattggcttgcagggcgggggcgggattgttgagcaggctcggcaggttttgcaggttggcagtcatctctttttcggaagtgaagaaagagatggctacgttgacagggtagcgcggagagcggacgagggctgtatagttattgtcggtcttggccagctctacattaggagtgaaggtcacggttacggtttcgccactgggatgacgggcgatgacggagttctgttctacgctgacggtgatgtctttgccccattggctaccggagaacagcaggtcttcagccgtgtcggcttcgatgcgcagcaaggcggtcgaggcacttgtgaagttgagccgttgcgtgatgctcccgtgggtggaatgtgccgacatatagagctcgccagggtaatagcaagtggaatccggaacaaaaatctcttgtgtatctttggcaaagcttacgacggcggctgactgtgccatccactggcggcggaacatatcgaggctgaaggggccgcagaagccgttgacccattgttgccgttcgggcagcgtgaagcccatccacgagccggcgtcggtgaaccaaccatagcagcggtgcagggtgtcgggagtgtaggagatgtccagtatgtcggcgaaggcataccgtttctccgtagtgcttttcatgccgggggtgcaggctgcgatgcctgcggccaacaatgtgaagcagagtatgcgtataaatttgtatttcatatgaatgaggtatttaacggttatttgtgcgcttgttccgctgcatcatcctccggtgcgagaggggcgagcgtgaagctgtatttccattcgtgcggagtgatggtgtactcgggatgaacttgtgctccccaggtattgtcaccgcctacgcccatctgcttgtggtcgatgttgagccatatcatatctttcttctggatgcttccaccgtggcggcgctccatctgtgagggacggtattcaatgtcctccatcgggaagttccaggcgcttacgctcaacggttcctcgcccactaccagcaggccttcgccggttgcattacgtagggccacccagcgtacgtcacaatgattggccgtctcttgggctcgtacatacggatggtactgttcccagactgttgcgttgtataggcctatcaaggctcccgtcttgcggtcggcatacgtctcttgcggaccacggcccagccaggtcatcatttcatattcggcagggagtatcatgcgcatgcccagacgaggcatctcgctcaatggcttcttgccgggggtgaagtgcatggttacctgaaccttgccgtcgggagtgattttgtagagagtctgcaaatcagcatcttgttcttccatgcggtaggtcgcagtgacagtagccgtttgtccggcttctgcaacttcgatgttctgcagtttggcatcgcgtccggcgtttctccaggtgccgcagcgtatcaggtgcccatttggaatatcattatcggtcaacgggcgccagaagttgggttgtagcccttctttaatcagattctttccggtgtagttcaactctgtcatttcaccgtttcgggtagagaaagctacctggaagttgttgcctttcacggtcagtgtttcgttgttgcggtctacggtcagcgttccttccaccggctgaacggttttggctgacggtgcagaaggcaattcccattgttcgatggcaacctcgtgtcctttcggtactaatggcgcttcgtgcttggtgaatgcacgcagtgtgaggaaatactccttgccgtcggcaggcagcgctttcagtggcaattctatgttggcagagtttctgggagcaatcttggggaaatccatctcaccgttctgaacggtcttgccgtcgcattccactgcccagcggagggtatatccttccaatccgatgaaatcgtgccagttggtgacctttatcttgttcggggtgaaggcaagcggttcgaagtggatgtattgcaataccttcttcacttcgtagatgtgcgggtgcggggtgcggtcggcagcaaccaggccgttggcacagaagttggagtcgttgacgacgcctacaaatcccatgtcgccgccaaaagcccagatgtcgcgctggttctcgtccttgatggcaaacgtctggtccacccagtcccaaatgaaaccgccttgcagttggtcgtacttgtaaatcaagtcccagtagtcctggaagttacctacactgttacccatggcatgggcatattcgcagagaatcatggggcgggcatcacgctggttcacgtgttggcgcaacctccagatgcgtgcgtacatggggcaatagatgtcgctcttggagttgtagccacccccttcgtattgtgcgggacgggtggggtctatctttttggtatagtcatacagagtttcgaagtgcttgccgtagcccgactcgttgcccatagaccaagtcacgatggcggagtagttgcggtcgcgtgcaatcatacggctcatccgctgcatgaaagacacctcccagtcgggatagttggcaagggtctcatctttgtggaacatcatgccatggctctcgatgttggcttcgtctaccatatagagtccgaattccgtgcaaagctcgtaccacgcatagttgttcgggtagtggcagttgcgtacaccgttcaggttgaactgcttcatcagctggatgtcgtgtatcatggaccccacggtgatggtacgtcccttgtgcgggtcgtgctcgtgacggttcacccccttgaagaggacggcctggccgttaatcatctgcatgccgttcatcatttccacggtacggaagccgaaaaggtgtgtaaaggattccagaggtttcccttgtgcgtcaaaggtgctgactaccagcgtgtaggtgttcggtgtttcggcattccaggtgcgtgcattcgggaagacttgctgctgggtaaacaaggtgtccgtggcagaggctatggacttcttccggtcatagataaccttatccctgtccattaccttcacttccaccgtttctccggctttaggccgatggaggaatacatccagctttagttcgccatccttgtagttgtttatcagttccgctgtcatccggaagtccttgacgcggctctgggggcgggcgtagagataaacactccgttcgatgccgctgtatttccagtagtcctggccttccaagtaggaaccgtcgctataacggaatacttttacagccagtctgttgttgcccttcttcagcagcttggtgatgttgaagtgcgacggcaggcggctgtcctcggcataacccgccaattcgccgtttacccatacatagtaggcagactccactccttcgaaatcgaggaaaacgtccatgccttcccaacctgccgggacggtgaactcgcggatataagcacctacgggattgtagtcggtaggcacgtagggcggattgggggggaacggataacgggtatctgtatagataggtgcatcgaagccttgcagttcccagcttcccggaacttcaattttactccacttgcgggtactgaatccgggcttgtgaaagtctttggggcagaggtcattgttctttgaaaaaagaaatttccaggtgccgtccagagtgatacggcgttccgttgcaggattaacgtcgaaccgtacgtcggcgggcaaggcacgttgtttcaatgcgttggcttcattcgtaaacggggtgaagtgggcgtgcatcggttctctgttcatttcgttgacttgcgggttctgccacggctcgttgtcggccagggcatcggtgcaaagcagcgaagaaaggagaaaggtataaagtttggttttcattattaataggatttagtgatataaaaatggctcttgtcagagaccggtgtctgtcaaaagagggtaaaagccctatatcgagcagaacaatgtcaccaggaacggaacgctgaaatcgaccacaaacccgtggaagatggaaaccactacaaactgctgtccggctgtccgtgtgatgatgggtagtgtggtgtccatcgtcgtggctcctccggcagagatgggggcaaggtttccgaaccatcgtaccagcaacggggcggctagcagtgtcagaatctcccggctgatattggcaagcagggcgatggtgcccagctcggctcccttgtattcggtaatgaagatgctggagagcgagtaatagccgaatcccgagcctacggccagacagtccgttatagaacggtgtgtcagaatcagactgacggctgccgaaccagccagtgttcccagtatcgtcatgatgggcaggaataccagtcgcggattgagtgaacggaagttcttcagggtctgcgggtcgttgcctacgctcaaccctacactgaacatcagcgcgcaaagcgcgtagtagctgatattggtttctgcaatatcaaaaggcagcagatggcacacaccacaaatcgtacccaatacaaaaaagcccacaatgataagacttcctttcatgccctgcctcctttccttttatacaaggctctccagagtgcccaagcagcgataacacttcccaaggtccctcccagggtgaggacaacggcttcatatccgatggtatggagtcctctgataatctcttcgttacttcctacctcaataccgaggataaacagtagcagccagataagcagggtgatgattggatgaatcttctttaagtcccgtttccgtaagaggtaacccagcagcattcctgtgagcattagtccgatgattgtaaacattgtctgtatggttttgtgaatagatggaaagctgtcttaccctcaaaagcgcctcctgtttaaagaggggaaggcgcttctgaggtttgacaattgcaaaattacttcatttccaaatatctttggttctctttcactcctttttcttgtgcagggcataagcggaatgagaattccatcttacgggcaggaatcaggtatggttgatgcgggtaggctccccaactggtatctccacccacacccatctgcttgaagtctatgttccaagtcaccatatctttgggttggatgtctgagatatggcgttgtgacttgcgtgtgccgggttcatccagatcttctgtcgggaagaggtaggcactgccgctgattgtgggtgcaccgataaccatcaggccattgcctttcaaatcggtgaggctcatccaacgtacatcggtcttgttgccgttttcttgtggacggtcgtaggcgaagtactgttcggctacgctacctttgtacagacccacgaaggaagaaccgttgcggtcgcaatagttctcgtgcggacctcgacctagccatgccatttggtcgtattgcttgttcagggtgatgctcacacccatgcggggcatcaaaggtaaagtgtcgttggcaggaatgaaagtacagttcacatcgaggctgcctctcggtgagaagcggtagcggacaatgaattccgaaccggcaacttcttcgggcagacggtagtgtgacactacttcatagctatctttgtcgagcgctgttttctccaatgaggtgagtttgacgccacgtccggcttcacgccacgggcgcagggtcttgttcatgtcgttgcccatgtcattgtccgtcaccggacgccagaagttgggacgcagtgcttccttaatcatctcttccttgccttccttgaacgagcagagtgctccggtggctttgtcgaatcctacactgacatttccggcagtgaggacaagcagggcttcgctgtcgcttgccgtcacgttgcctgaggcagctttgggggtaacagccttatagaagggaagcttcacttgttcggaagccaattgtgtaccggccttcagcagaccctcgtcgcgcttctggctggcatagaaattcaggtaatattctactccttcggtggaatgtatggtggggaactgtgtccggaatatgcctgtctgttgggcgggcaaatctacattatctatgcgtccttgtgccaatacttcgccgttgccttccaaacgccaagtgaagtcaaagtcattcaggttggtgaagaagaacttgtttctaagctctaccaatccttcgtgataatcgagcaatctgaaagccatattctggtacacccgtttcacttcatgtatgtggggcttcaatgtgcggtctgcggcaattaggccgttcatgcagaagttggccgagcttggagtgccttcgggggcaaggtcgccgccgtaggcccagtagaacttaccgtcgtcggtcttgttgtaaagaccctggtccacccagtcccagatgtgaccgccttgtagagaagggtacttctcgatgatgtcccagtagtcttgcagattgcccacactattacccatagcatgagcgtattcgcagaggatgaggggcatggtgggcagatagagagcatggtttatcaacacgtctatcttcttgtacatggggcagaagatgtcggtgaaaggacggtttttgccagagtcctcagagtgtacggggcgttgggaacggtcgtgggcatgaatccaagcataggtggcttggaagttacagcctgagccagtttcgttgcccaatgaccaaataatgacgcaggggtggttcttgtcgcgttcaaacatacgttctgtacggtcgatgaaagccttctgccattcgggttggttggcgaggcattggtcgggtttgtagcccatgccgtggctttcgatgttggcctcgtccactacatacatgccgtagatgtcgcacagttcataccagcgcgggtcgttggggtagtgggaggtgcgcacgctgttgatgttgttttgtttcatcagttccaggtcgcgtatcatggaggcttcgtccactacatggccgtggtaagggtcgtgttcgtggcggtttacgcccttgatgtagacgggttgcccgttgacgagtaactgtgcatgtttgatttccgatttgcggaatccgatgttgcggcagatgtactgtgtctggccgttggcacgcagtgtaatcatcatctggtataggttgggcttttcagcactccacagtaggggcgcttcgatgtgtttcaggaagtgcagcttgttgtctttggcgcgttggcgttcggtgtagatgacttttccctctttgtccgtcaggctcacttccacttcggcaccttttaccttgggcgtttgagtacgttgggagttttgggcattgtccagttccacatagaggtggaagtcggcgtccttatactcgttgtcgaggtcggtcactacttcaaagtcgcgcacgtggatgttgggacgagcataaaggtacacatcacgttgtataccggcaaagcgccagtaatcctgatcctctaagtagtagccgtcgctgaacttgaatacctgcacggcaatctcgttctgtccggttactgcatagggggtgatatcgaactcactgggggtcttggaatcttgcgagtaacccaccttttcaccgttgacccacacatagaaagctgaggccacgcctccgaagtggaggacgatttgcttgcctttccagttggcagggacgttgaatgtgcgtttgtaggaacctacgggactgttttccacggcaatgagtggtgggttgcgcttgatgccgtagccggcacctacatagaaaggatggccatagccttccatttcccagttggcaggcactttgatgttgccccatccgcttacatcgtggcctttttcaaagaagtccatcgggcgctggtccgaacggggaacaaactgaaacttccaggtaccgttcaacgactgaaaatattccgattgactcttgtcgttcttcactgctttctctttggtggtgtaggccatgaaggtggcggcagagggcagacggttgatgtgcaacacatcaaagttttcccaatcgttgtccgagtgaggatatttgtcggttcttacggcggtttccgctttcttggtgtcgcccgtcttgttcatgggtgtaccgtcgtactgtgcaaatgcgcataacggtagcatcagtgcgagggtgcagattgaatgtatcttattcatattcgtattcgtatgcttttaatgatgtataatcgtttgtcttttcagacttttgagagttgttttgcgtgagagttactcatcgagcagcatcttgatgatacatgccgaactccagccgaagttaggcgaattgagcgcttcgccggtcagcgggttgtagttctcgtggatagggccgtcggtggtgagtccttgggcgttgttgatgaacttctcagtcagtatgtcggcttcccggtcgaaaccatagttgcgcaggccggtgataccgaagtacacttggtctacccagaccgggccgcgccagtagccgcgcacgggacgcaggcgaggatggctgatgtccaaggtacccaatggaagggtggagttgaacttctgcgggtccatcatcttctgcatcacctgtttggcctgttcgggagtggcgatgcctgcccagagtggcagccagcattcggcacccatcactttgatgtgctcgccggtatcgatacgggtgtcgtagaagaatccggtttccttgtcccacatctttgtctgtacgaactccttgatgactttggcttcggcattaagctgtgccgccagttcgggcttgttcaggagggttgccatttcggcgaggatggtcttgtctacgtagaggaacgagttcaggcagatgttctcctggttcatggaccatgccttctcgctgtttttctgcatcacggcatcgtcaaagcgtacgccgttgtccatgccgctttcccaacaggcagcaatgagagtgccgtcggtggaaccgtattcgcagatgccgttgtgattgtggtcgcgctcggcataccaccactgatggaacttatagagcttgtcgaacattgtttcgaggaatttcttgtcgccggtagctttatacacgttcatggctccccaggcggctacgggcggtttggcatcgcgccagttattgtatttcttgttgtagctgatgaagtcgggtaccatgccgttgtcggcttgatagtcgaagagggtaatcatttcgcttttggctatctcctcgttgaaatgtacgttgcccgaagcaatcttccaggagtcccacgaccagatgccgttgatgaatccgttgtacgacgggttgctgccgccatgcaggatgtcaccggcaggggtgcggtagttgctgttcagggtcatcattgcttttacgagtaccttgcggtatttgttgtccttgaggtacttgctgtttccgctcagcaacgaagcgatttgtgcgttccattgctgttcgtttagttcaaagcaattgtctatattcagcgttgctatggcagccagttctttggctgtgtcttcaccgcgcagcgtcagggtttgagtcatctccgactgataagtcttgccgggttccagggtcatttcacttttttctgtgacgtgcaggctatcgctccccacagcctgaatcttgtctgctgtgaggaatcggattaccgtgttcgtggaatctttggggcggatgaaagagagacctttatctatgctgcttacgacagaggtaggctcgtatacgcctccgttccagtcgaagctgacctttaccggtttttggctcatattcttcacgattgaacgtatggctacggaacgtgaggtgaggtagcacaattcggtagtgaagtttaagttctcatcgttgtattcctgtatcagtttgccggggaggtatcgggtggtctgtacattgtacaccatcctatactgttcgccgttcacccacagcgtaggttcggcgagtccggcagctatccatccgcgtccggtcatgaccataggtcccatgaaagcaccggcatggcgacggttttcgttgtcgggcagtgagtatgccatccaagcacctttgtcggcaaagacgtaggcatcccagtctacggctccggcgggagtgttctttatgttgataagattacagaagtccgcttgcttggataaaagcggttctgaagaagtgggagctttgacgcacgaggccagtatgcaggcaacgatgccagtcaaagcgatgtttttatttggatgtctcatggtaaattaagtatatgatgaaatgaagtcttgaaacagagagttctattaaaagcaatctctatcggatgggatcccgtttccggcatttcgcttccgatagagactgagttgtagggttatcggttattttgtgtaaccttcgttttgcacccaatcaggattcatcaggaattctttgtgagggatagcgagtctgatatgcttggtcgatatgaaattgcttgcgaaaggcttttcatgactcttaagtgcgtcttccacaatgccccaacggatgagatcataccagcgtgagccttcgagggccagttcgcaaggacgttccacatcctgcaggtgcttcagcacttgttctttacttagggtgtcggacagtggcgttacgtgtacacggtcacgtactttgttgatgtatttgatggcttctttagagtttccttcatcgttcagacactcggcatagagcaacaggatgtccgcatagcggatgagggggatgttgaaaccggaataatcccagtaatcacccaatgacttgtcgtaagtcacatatttgcgccagtagatattgtcttcttggtggtaatcactgaatcctttgccgtcttcgtaatagaacggacgggatttgggatcgtcgaaaatgatagtctcatacaatcggtcgctgtattccccatcttcggtgaggtctttcttcagtgtattgaataaccatttggacggatatgcttcctcgtatgcgccacagccactgtcgggacccaagtgcaaggtaaagagattgtattcgtagtgcccgccttccagacttccggtgaactgtacttcaaggatggattccttattgttctcgtgtagtccgttgaagttgtcgccatagttctccatcagttcatatctgtgactgtcaatgactttccagaattctgttttggctttggccttttcgccgatgaacatatagtatttgcctaagagtgctgcggcagtatatttagtgacgcgtccggccatgtttgtattccatttttcgggaaggttggcttgacattcactcagttctgtctcgatgaaagtcttcagtctgccggcttctacctgaggaggatagaattcctcttcggtaccttcgagttcgtgctcgaacattggtagtctttcaccgaagttgatgaagagacggtagtagtagaaggctctcagaaaacgtgcctcggcaatactggtcgctttggtctgcttgatgccttcgtcatcgttgtcgggcacattgggaatgttgtccagacactggttgcaatagttgatactggtatagaggttggtccattcatcgttgggcacgtagttggtcgattcgttgttgtacatggccagttccatccaggcggtcacgtcggggcggtagtccagctcgtcgctgcggtagttgtctatcacaatgtagcgttcgaaaggttgcgcccattcgatggtaggctgtagtccagcgtaggctgcggtaagtcctttgaggatgtcggattcgctcttccagaagttttcggggtccagtgagttggggtttctgtcttcatccaggaaatttccggtacatgaagagagtgccaggcctcctaagactgaggcgcacaataatatattctttaatttcataatcatcttttttaaagttttggttcaattaaaatccgaatttaataccggccatgaaagtgcggcatagaggtgatgaagcatagtcgtaacccatgcggtcaataccaccgttggtagaggggtcatagccactgtaaccggtgatggtaaagatgcgtgtaccacctacatagaaacggaggttgctgatgcccaacttaccacaaactgtagcaggcaggttgtagcccagttgcaagttgttcaggcggaagaagtcgcctcgttcgatgaaacggtcggaagtgcgagcattcttgttcgggtcgccgtatacggcacgtggaatgttggtgttggggttctccggagtccatgctttcagtgcgtttctgccatagttgaacttggtatccatacgttccaattgatatttggtatagttgtaacggtctacaccgaggtcaccgtagaagttggctaccaaatcgaagtttttgtaattcagtgttacgttgaagccgatagaggccttggggcaaccgttgcccagaagcttcttgtcatcgctgtccagcatgccgtcaccgttttggtctacgaagcggaggtcaccgggttctgcgttgggctgcatgggaatccagttgcctttgctgtccttgcgtccgtgtgattctttccaaagtttggcttctgcttcattttggatgatgcctgcggtttcgtaagcccagaattcaccgaagtaaccacccacgtaggtacgtgaagcaccatattcgtacatatagttggggtctgccattgatttcagtttactcttgaagtggctcaggttgaagtcaaggtcatacttgaagtccttacctgcattaccgtggtaaatcagttgcatttccataccggtggtgcgcagttcaccgtcgttcaccgtcagtgcaccgtaaccggtagacagactgatgttcttttcggaaagcatgtccttggtgtccttgatgtaaccttcaatcgagaattccagtttgttgttccataggctcatgtccacaccgatgtttttgtagaaggtagtttcccacttgatgttccttgaggggaggctacgtactgcatatccctggtttacgactttgccgtcgaaggggtagttgatgttgtcggcgttggagtccaatttgggaatgtagagatagagaggtaccgattggttaccgagggcgccgtagctcatacgcaatttgaaggagctgactgtttctttcatatcttcccagaaaggttcgttggcaatgttccagcctactgatacagaggggaagaacccccactggttaccgtcggcaaaacgtgaagaaccgtcatagcggaacgaggccattaacatgtagcgcattttccaactatagttcacacggccaaatacggaacgcaagccgctacgggtcttttcaccttgcacaccatagtctttgcgtgcctggcccagaatgcccatgtcgttgttctcgaattcggaacccgatgcacccaataggtcgtaagtgctttcttcttgtgaagctcccagcaggaaggcgaagtcgtgactgtctttgatggtgaagttgtagttggcagtcagttccagcaggtcgttgacgcttctggtgcgggtctgtgatagtgaggcgctttcgttccacttcatggcacccagttcgtaagtaggtttgaatacgcgggtttcgcggaaaaggaggctacggcttgcttgtgccttgattaccagtcccttgatgggctcatattgcagatagcccgatcctttgatgtaatctgtggcgcgggtgttctcaatcaggttattataacctaccatgttggcagcatcgctcatgttcatgccggggatggcaccaccgtatccgccgtcacaattctcgtcatacagacgtgcgataggttccatgttggtcacttggtatatgccgggaaaacctgagttggcttccatttccgattcccaacggctgtagtttactgattcgcccactttgaacttgccgcgtttcatgtctgagtttaagcggaagccatatttctcgtcacccgtgccggtcacgatggcttcgttttttgaatagaatacggacaaagctacgttggcattctcactgccactagtgtaccccacattgtatttctgtgtgaagccgttgcggtagtattcgtcctgccaatcggtgtcgccaaactgtgtggggtcttgctcataagccgcaatgtaagcaggccagtttttggggttttgaccggcgtttgtacgggccatctttgccatgtggataaattcttcggcattgcagacatccagtttcttggctatctgatccactccccaataagctgagaacgtgattttgggtttggatttggtaccacggtaagtctcaatcaggataacgcctgcggcggcgcgtgctccgtaaatagcggcggtggcagcgtctttcaatacagacattgacttgatgtcttcggggttcagaaaactcatatcacccggaacgccatcgataattaccaacggagagttgtctgttccataagtggttacaccgcgcacctgcaggctgggagtggagccggcggcaccgctaccaaagttaactatcaaaccgggagccataccctgcagggcagtttcggcattagcggtaggtatgttgtttagtttatcgcccgatacggaacttaccgaaccggaaacatccgatttcttttgtgtgccataaccgataacgactacttcgtccagtagttcggtgtcttctttcagcaccactttcaattccttgcgaccattgagggcgatttcttgtggagcatagcccacgtaagagataataatagtggcttttggggaaacgctgagggtaaagttaccgtcgatgtcagtgattactccatttgttgttcctttctctaatacactggctccgatgacagattcaccggaaacatcggttacggtaccgttcagctgaatgttctgtgccaatgcgcccataggcagcataaaagcaaagaagagaagtagctgaatgactctttctttgtagtagttacttttactcatttgaataagtttttaaggttaatactattggtttttcacaatgctaaattaagcttcataaacaggaattgctaatgaatgttatctacaagcagactacaagagagggatattctttgttttattatctacaaatagttttgtaagtatttgataaataggagtaaatgaaatattctatatctacaaaactatatccacataaacttttcccgatttacattaattattgagttgcgcaagtaaacggtgattagatgaagaaggaaaccaactcttttagaaatatcaagcaactcaagtttcgcaagtcttttataatcattgataaacagtagtatctcaactctcctccgaggaggagagttgagatactactgtttatcaatgatgtcccttgcagatggtttgcagatgttttatctgcaagccatctgtaaaagaggaagtcgagtataagacggatgacattcatatcttatctcttgcaaaatacggataacttattagttcatagtgatgaacactttgtttctgcagtacaaaacacttcgttcatgtagtataaaacgttttgtttgcacaacataaaacaaggtgtttatatagtatgaaacaaagtgttcactataatggaacaaagtgttcgccctaatgaaacacattgttctacacgtcgaaataaaccgttctgtgtgttgaaacaagcggttatattgggggaaacaaaaagaaagctgtcttttcctgatttcactagacactttttttctttataaacgtcatcagtagacggttctttcatttgcatactgatacagtagtcccttcttccggacttgcgagcctatgcttacttgttcgatgccttgtttctactgagacaaagtgagagcaaactttaccctcacctttttgaaattgcccttactcacctctgaaagtccgatgaataaagacttttaggtaagcagtgagggcggtgagggtagaaatgcaaaataaatattttcagccttgagccgggttatatattctgtagatagtcggttaggtcttcttcggaagagaggttgagggatttgcgcaggcggtatcggttcatattgatggttttgggggtggtgccggtcaacatggatatttctttggtagacaggttcacccttagcagggtggcaagatatttctcgccttgtgtcagtttgggatgaatcgctaccagtctttggaggaattcattgcttttatcatcgatgtttgtcaatagggcactgttggttttgtctccgctttggctctggctgatgaatgcgttgattttcttcaggtggggcgtgatggcttgcgcgtccatcttatatccttctttcaccattccgcgtattttgtccagcagttcattgcggcttttcaggaatacggcgaagctggttgcctcctgccgactggtagccagggcattgtgtacattttgaagttccagctcttgctgatgcatcttcagttcggccacttctttttcggacagttgcaattggtagcgtgcttctatcagttgcaaatcttttcggcgtttataccatttatatagaaagatgctgaaagctattcccagaataagtacgctgcccaaaagccacaaattgcgtttcagtagctctatcttgtaggtttgttcctgcatttcagtagcatatttttggtcttggtatcttttgtaggaaatttcctgctcgatgttgcgtagcttgttgctactttgcagttccttgcccaggtggtacctcttgttcagatacttataggcttgggcatagtcacctatagctgcatataccatggacgaatattcgtaattgtcgcaaatcagttcgcgggctccgatgttgtgggcatactcgtaggctttatgcaaggcttccaaggctttggagtattgcttgtcatagtaatactgtttccccatgttgttgtagttttcgccaagagaccattgggcatccagattcttgttgatggtgatggcttcctggatgaaagaaagtttctcttccgtatttccccggtacagacagaggttgttcaggttggttgcaatctctttcaggtttcgttgggcacggttgatggccagcgcacgctggaagaaacgctcggcaacggtaaattcactcatgaagtggtgcattactccacgttcgttatagcatccggccacagaggtggaatcgccgatggatttgaagatggaggttgctttgtcgttcagttcaatggctttgttgtaatcgcctagtttgctgtatacacgccccatcaaggagcagagttgtgccatttgttttttgttggtgggatggatatatttttgggtgtcataaagattcttgatacttaggtcgaagttccccaacaattgttcggcttgacagtagagaatcatagcttgtgcgcggacctcactgggctcatcttcgggaaacaaggcagaagcctgagctgcatagtaggaagcttgtttggggttgttgtacaggtatttctgtgcttggtcaatcaatttctgtgcttgctgcatgtcttgagcttgcagtggggcagctgctgacagaagacatacgagtagtagacataggtttttcttcatggcatcgtcttgtttctgcaaatttaattaattcttcttagaagtccggtttccctccaaaaagatttatctttgtgcctcaaagatagcgatatatatgttattaccttatttgaataaagatttgatagaggcaggatgcgatgaggccggtcgcggctgtctggccggtgcggtctatgccgctgctgttattctgccaacggactttaagaatgaacttttgaacgactccaagcagctgacggaaaaacaacgctatgccttgcgtgaagtgattgagaaagaggctctggcatgggcggtgggcgtcgtctctcccgaagaaattgacaaaatcaatattctcaatgcctcctttcttgccatgcatcgtgctgttgaccaactgaatgtccgtccgcaacatctgctgatagacggcaaccgctttaaaaaatatcgggacttgccgcatactaccgtagtgaaaggagacgggaagtacctttccatcgctgccgcctccattttggcaaagacctatcgtgatgactacatgaaccgccttcacgaggaatatccgtattatgactggaatcgtaacaaggggtatcccaccaagaaacatcgtgccgccattgctgagcggggcactacaccctatcatcgcttgacgttcaatctcttgggggatgggcagttgtcgctgaacttcggacaatgatgctgtttagaaccacttaatccttctgaaccatacgaatgtcactgctgataatattgctgacaaaagtatgatgaaaataaacgcgtgcggaaaactctccaggtggatgtccacattcatgccgtagaaactggctatcaacgtgggaatcatcagtgtaatgctgaggcttgtcatacgtttcatgatggcattcacattgttggagatgatggaggcgaaggcgtccatggttcccgtcaggatatcactgtagatgtttacggtattgtatgcctgcttcaactcgatgaccacgtcttccaataattccaaatccagataattggtgtcttgaaagatgtttttcagccgtcctatcatcacttcattgccacggatggaagtgttgaagtagaccagcgtcttctgcagcttcatcagttgcaggagatcttcgttgcggatgcttttttccagctctttttcggcggtggccacatcgttgtttatctgtttcagatacttcaggaaccagacggcggaagagtagatgattcgcagaatcaaatccagtttattgttgacgactatgttcttccggcgtgtgtgctggatgaagtccggtatcagctccgtgtggtgatagcagacagaaacgatgattccgtcattggtgataatgccgatgggtacggtgatgaacggcacgccgcgttggttgctctgcatcgggatgcggaggatggtcagcagccagttgtcttctgtttccgtacgtgggcgctcgtccacgtcggctatgtcttccaggaatgattcgggaactttcagctcttcggttaggaatttgaaatcatcgttgtccgggcattctacgttgacccagcagttgggttgccattcggccttttcagtgaagccgttttcactgtagagatactttctcattgtttgcctcctttctagttggaacagaggcattgcagtcaacgtctccgttcgttttattggtgaatactattgcacgttcgtgggtttgaatcgtccatatttcttgtttttttattttttaagcgtggcaaaagtacataaatcatttgaaacagtacgctttaacggctgttttttgtacctttgcaacgcaaaaaataggttcctactataaagaacgtttgtatcatacaaaaagattatacaattaaattcgattaatattatgagtaagaaagcccttttaatgattcttgatggctggggcatcggcgatcaaggcaaagatgatgtgattttcaatacacctactccgtattgggacagtctgttggcaacttatccgcattccgagcttcaggcaagcggtgaaaacgttggtttgcccgacggacagatgggtaattctgaagtaggtcacctcaatatcggtgccggacgcatcgtttaccaggacttggtgaagattaaccgtgcttgtgccgatggcagcatcctgaagaacaaggaaattgtttctgctttctcatatgcaaaggaaaacggcaagaatatccactttatgggactgaccagcaacggtggcgtgcacagctcttttgaccatttgttcaaactctgcgatatttccaaggaatacggtatcgagaataccttcatccactgctttatggacggtcgtgataccgacccgaagagcggtaaaggcttcattgagcagctgactgcccattgtgagaagtctgccggcaagattgcttccatcgtgggacgtttctatgccatggaccgtgacaaacgttgggaacgtgtgaaggttgcctacgatttgttggtaaacggtgaagggaaggtcgctacggatatggtccaggctatgcaggagtcctacgacgaaggcgttacggatgaattcatcaagccgattgtgaacggtggcttcgacggtaccatcaaggaaggtgatgttgtaatcttcttcaactaccgtaacgaccgtgccaaggaattgaccgttgtcctcacccagcaagatatgcccgaacaaggcatgcaaaccattccgggcctgcagttctactgcatgactccgtatgacgccagcttcaagggtgtacatatcctttttgataaggagaatgtacagaacacattgggcgaatatcttgctgccaatggcaagacccagctgcacattgccgaaacagagaagtatgcacacgtgactttcttcttcaacggtggccgcgagactccctacgatgctgaagagcgcatcctggttccttctccgaaggttgccacttacgacttgaagcctgaaatgagtgcgtacgaggtgaaggacaagttggttgaagctatcaagacccagaagttcgatttcatcgtggtgaactacgccaatggtgatatggtgggacataccggtatctacgaagctatcgagaaggcagtgaaagccatcgacgaatgtgtgaaagacaccgttgaggctgccaaggcaaacgattatgaagtaatcatcatcgccgaccacggtaatgccgaccatgctctgaatgaggatggtactccgaatactgcccactctctgaaccccgttcctttcgtttacgttactgcaaacaaggacgccaaggttgagaacggtgtattggctgacgtagctccttctatcctgcatatcttgggtatggagcagccggctgaaatgactggtaaggatttgattaagtaaggcgtcaaagccgtaacaatatttagacgcggattatacggattccacggatgctcttaaagttgagtctgtgcaatccggataatccgcgtcttttttcaatagaacgattatgatacagattggtgatgttgtggtttctttcgatgttttgcgcgagaagttcttgtgtgacttggatgcctgccaggggatttgctgcattgagggcgatgccggtgctcccgtagagctggacgaggtggagaaactggaagaggtgcttccgctgatttgggacgagctttctcccgaagcccgtaccgtgatagaggagcaaggtgtggtctataccgattgtgaaggtgacctggtgacttctattgtgaacaacaaggattgcgtctttacctgctatgatgataaaggctgttgctattgtgccatcgaaaaggcttaccgtgagggtaggaccaacttctacaaacctatatcctgccatctctatccgataagggtggggaactacggactctataaggcagtgaactatcatcgttgggatgtctgcaaagccgctatgctgttgggacaaaaggaaaatctgcccgtgtacaagtttctgaaagagccgcttatccgtaagtttggtgaggactggtatgcagagttggaattggtagtggaagagatgaaaaaacaaggaatcctatagttcttccgtgcggagacgggcctcttctttggaggagaagagggataaaggaaaagccccggtcagcaggattatcctgcccgtccggggcttcctcgttgtaagatgtgaggttggttatttattatttattaagcgtcgatatttgcatacgttgcattcttttcgatgaaatcgcggcgcgggcccacgtcttcacccatcagcatggagaagatatagtcggcttcggctgcattttcaagatgcacctgcttcagcatgcggttttccggattcatggtggtttcccacaactgttccgggttcatttcacccaaacctttgtagcgttgggtgtgtactgcgttttccgaaccgccgccgtaagtgtcgatgaacttctggcgctgctggtctgtccagcaatactctttcgccttgcctttggtgcaaaggtaaaggggaggagtggcgatgtacaagcaaccctgctggataacttgcgggaagtagcggaagaaaagcgtcataatcagcgtgtcgatgtgagaaccatcgacgtcggcatcggtcatgatgataatcttcttgtagcgcagcttgtcaatgttcgcttctttgctgtcttcaccgtccacgccgaaacggatgcccagcgcctggatgatattgtttacttcgtcgctctcgaatgccttgtgccacatggccttttccacattcagaatcttaccgcgaagcggcaggatagcttggaacgcacggttacggccttgctttgctgaaccgcctgccgagtcaccctcgacgaggaacaattcgcattcttccgggtccttgctggagcagtcggccaacttaccgggcatgccaccgccggacatcggcgatttgcgttgtacggattcgcgtgccttacgtgcggcgatacgtgcctgggcggcaagaatcaccttgtctacaatcagcttggcttccttcgggtgttcctccaagtagtaggtgagggcttcgcccacagcctggtctacggcacccatcacttcgttgttacccagctttgtcttggtctgtccttcgaactgaggctctgccaccttgatggagataacggcagttaatccttcgcggaagtcgtcgcctgcaatctctaccttggctttctccagcatcttgttgtcttcggcgtattttttcaatgtacgggtcagtgcacggcggaaacctgccaagtgggtacccccttcaatggtattgatgttgtttacgtaagagtgtacattttcgttataagaagtgttgtacatgatggctacttccaccggtgtgccttgcttctcggtgttgatgtagattacatcattcatgaagtgctcgcgtgaggagtctacgtagcgcacaaattccttcaggccttcttccgagtagaagatttccttcttggcatttccctcttcgtcctttacgcgaaggtcggtcagtgaaatcttgatgcctgcgttcaggtaagccaactcgcgcatgcgggtggcaagaatatcatagttgtagactgtttccgtaaagatggtatcgtccggccagaactgctggcgtgtaccggtaatgtctgttgtgcccacttccttgacggagtagagcggatgtccgcaggaatattcctgctgatagatttttccgttacggaaaacctgggtagtcatatgtgtagacaaggcgtttacgcaagatacacctacaccatgcagacctcccgataccttgtaggaacctttgtcgaacttacctccggcatgcagtacggtcattacaacttccagtgcggatttcttttccttttcgtgatagtctaccgggataccacgtccgttgtcttgtacggtgatggagttgtcctcgttaatggtgacttcgatgtggtcgcaatagccggcaagtgcctcgtcgatggagttgtccacaacctcgtacaccaggtggtgaagtcctttgctgctaatgtcgccaatatacatcgcgggacgctttctcactgcttccaaaccttccagtacctggatgttttcggcagaatagctcccgttattggagtgaatctgttcttcagtcataatcttttttccttattgtaataacagagcaaatatagtgaaaatcctcgggatatggtgctaaacaaacggataaattcgggtagtttacagctttttagcacagaaaagaaacttgtgtggaagcaggtaaatagagaggtataaatgagaaaggccggactaaaaagtccagccttgtaatatcttttgtgtaacagtcaacttaagccagcttgttgatatagatagccaattttgacttcaggttgttagccttgttcttgtggattacattagtcttagccaatttatccaacagttttgtgatacccggatacattgctgttgctgcagccttgtctgtagtagcacgaagcttacgaacagcgtttctcatggtcttgccataatatctgttgtgaagtcttcttgtttcttcttgtctgattctcttcagtgatgatttatgatttgccatctcgactaatcttttttaattcgtttatttttttattttgtagcccgtgggggaatcgaacccccctttcaagaatgaaaatcttgcgtcctaaccgatagacgaacgggccatcctttggtgagcgtttccgctcttgcaaagagcctttatttctcgtttgcggatgcaaaggtagaaactatttttgaattaccaaaacattcgcaagaaaaaaatatagctttttgtagctttttgtcctaggttaacgttttatttattgaaaatcagtgcgatacgcgcttttacttttttacactccttaccttgtttttttattcttctccttttgtttctcttctttcgggcttttttttgtagctttgttatcagattgaaaccagataaagaaatcgggaatgttacagaaaacactgggaattgtgctgcataccttgaaatataaggatacatctctcattgcagacatctatacggaggtggctggcagggcttcctttatggtgtccataccccgttcgcgcaaggcggcggtgaagccggtactcttccagccgctggcattggtggaacttgaagccgatttccgtcctaatgccactatatataaggtgaaggaggcgaagtctctttatcctttcgccacgcttccctacgatccctacaaatctgccatcgctttgtttctttcggaattcctttatcgcgccgtccgggaggaggcagagaaccgtccgctgtttgcttatctgtatcattccgtcatctggctggatgaatgcagggaggggtttgccaatttccatctggtcttcctgatgcgcctttcccgttttctcggtttgtatcccaacctggaggattatcatgccggagattacttcgatttgcagaatgcttgtttcactcccttgcgtccgcagctccattccaattacatcgctcccgaggaggcggcccgcctgacacagctgatgcgcatgaattatgaaacgatgcatcttttcaccatgaaccggttggagcgtacccgctgcctgaacattatgaatgaatattatcgtctgcatctgccggatttcccggtattgaaatcacttgaggtattgaaggagctttttgattgattatcgtcgatgtaacggcccaataagtgtgcgctgcctttattataggagtagggagttttacttactgctgtaagggtcgttacgataagctgtaacggtcgttacaatatagggtaaccgtcgttacatcattaggtaacggcttttacatcttatggtaaacggtcggtaaatataatgcgttgatagatagcgtataatctcttgtgggggaggatatggattggtatgtaaaaagccgtgttcaacagactttggacgctgagtccctctgttgaagcacggcttatatgataggggaagtgtatttctttatcccagcaactcttttactttggctgagatggcgcggccttcggcaagtccggcaagtttcttgctggctacacccatcaccttgcccatgtccttgccgctggtggcgccgacttcggctatgatttccttcaaggctgcctccagttcttcggcgctcatctgcttgggcagataggtttcaagcacctttacttgtgccagctcatcgtctgccaagtcctggcgaccttgctgtacatagatttcagcggcgtctttgccttgcttggtcagtttttggataatcttcaaagcatctgcatcgctcagggtatcgttggctccgggagcggttttggcttcaaggaatactttctttacgtttctcaatgtttcgagagccactttgtctttggctttcatggctgttttaatgtcttcgctgactttttcaaataaatccatattgttataggtttactcctgttcccccgaaggggaggaggatggttttacatatcgggaacggaaaaatcagaaggtgatgactccccctgcaccgccttctgcctcttgcgcggcttcggtggcgagctgcccttcctgctctgccttcatcttgatgctgttcagcgtgcttttgtcacgcagataggtcggagaattctctaccatgctgatgatgtcggcgttgtccatgtcttcgggattgaagagatagatatggcgacggcggctgcgctgggaacgggcattggcatccttgccatagtacacttcgcggcggttgcgtctctgttcctcttcctcctccagctcggcaaggcgttgctgttcttcggcggtgcgctgggtgatgcggtcgtccatctccttcatgtggatgtcctggataccgaaaccggtggcaagcagggtgattttcactttctgttccagcttgtcgtcaatggccataccgaatttggtttcgaagtcgcggctgaaacggttcatgaactccttcacctcgtccatctcgctcatcatcagcttgtattgtgcactgtaagagatgttgaggagtactttcttggagttgaagatgtcgttgttgttcagcaacggcgagtgctgcgcgttcttgatggcttcgctgacacggttgtcaccttcgccgtagccggtactcatgatggctacgccgccgtccttcagcactgttttcacgtcgttgaagtcgaggttcacctttccatgcagggtgatgatttcggcaatactcttggcggctaccgaaagggtgtcgtcggccttgtcaaacgcgtcgtctacggatagctcgctgtatatctcgctcagcttttcattgttgatgaccagcagggcatctacgtgcttgctgatttcctctacgccatccagtgcctggtctatcttcttgtcgccctcccagcggaaagggatggtgacgatgccgatggtcaggatgtccatttccttggcggtttgtgcaatgatgggtgcggcacccgtaccggtaccaccgcccattccggcagtgatgaataccatcttggtgccgtcgttcagcatattcttgatgtcttcgatgctctcttctgctgccttgcgggcacgggcagggcggtttccggctcccaggccttctttcccaagctgtaacttcacgggcacgggagagtccttcaacgcttggttgtctgtgttgcacagtacgaacgtcacgtcgtgtataccttcccggtacatatggttcacggcattgccgccacctccgcctacaccgattactttaatgattttcggtgaatcggtcgggaaatcgaattgtactatatcttccataataacttaattttctggcacattatcacattattacttcatatcgtcgtccgagaagatttcgttggaaagcttgttgaaagtcttttcgaaccagctggggccttctttctttttcttcttcttttcttccttttcgcgcagctccctttctttgcgctcacgctccttgcgttctttctcttccttctcgcgctgtgccttggcggcgcgtgcggcggcttcctgctctttcagcgcttcgtcgtcaacgaatatgtcgaccggtttgggaggaacattggaggcaggctgctgtaccggcttcacctcttgcaggcagcaattctcgttgccggcagccagcaggcccagcagtgtgttgtgcatgccgtccttcttgggctcgtcgctgcgtgtgtggacggtggtctgtacgaacttggcggtctttaccttttcaatcttgctcactctatggaaggctttctcaagattcttcagattggctcctccaccggtgaatacaacaccggagaaaagtttgtcctcgtagccggaaagttgcaactggttccatacgttggcaagaatttcttctgcacgtgctccaataatattgttcagcagggccagttcgaaggtacggccgtcttccgacgtgcatacggcaggggtctcggcgtcttcttcctcctcgtagagggcattaccgtattgcagtttcagcttctcggcatcttcctcttccatttgcagggaagtgatgtcgtgggtaatgttgtttccacccagcggcagtacgctgaggtagcgcaggatattgttcttatagaccagcacggtggtggtgtcggcaccgaagtccaccagtgcacagcccgaacgcatctcgttttcggtcagcacggctttggccaacgcagtgggagccacgagcaggtcgtcggcaatttccactttggcttgctcgaagctgtgttcgaggttcttcttcagcgaggcacgcgccacgatgttgaggaactgcccggtgatgtatcttccggcaactcctacgggctccacatgcagcgtgttgtctatcttgtattcttgcggggctacatccagcacactcatgtctaccaagggtacatcacggttctcgtcgcaaatctcgtctaccagttcttgcgaaatgatgctctcttcctccagcgtacggcttaccgcattcctcaccgtgcgcaatgattgtccgccgatgcctacatatactttggcgatggagttgttcaactggccttccagcttgttgatgatggaagtcagcgcttgtgcggccttgtcaatgttgtagatggcccctttgtgtataaacggggatgcatcttcgcgtgcataagccaacacctggatacttccgtcactgctcttctttcctgcgataccggaaatcttggaagaactcaactcgatagcggcgatgaaatctgttgttgccatatctatttatttactattttactatttacaatttactatttgctgcgctttgataaagaaggactattagtaaatccctttctctactctctctttgtgcagatgatttgattatcaaattcaacgctgatacgggagtatttgttccaacccacctggttcaatcctctttcgtagaatgcctttacacgtttcagcttcttctcgaatccggcaatcttgcctaaatagataagatggtcgccgacacggggcactaactcgatgttcttgccgggcaatacgtgaatttgctctatctgtgcattccaaaaagaattcttttgcaaaaatacaccaaacttatataaatccctcatggcaaacgacttttctacatttccggttacaacggcgaggtgtgcaacgcactttgcatcggggggcatcacggtacctttgttgtccagatagtagttttcgccgttggcgctcatcacgcgcaggatgggggtgcgctgggtcacttcgatgcagagcttgccgctcggggttttgtagcactccacctggtcgatgaggggatgcttggcaagttcgcgctccaaggtcttggtacgcacgcgttccaggtctttcccaatggggctgatgcctttcttttccagcagggtagctacttccttcttcgtgatgaagccggcatataccgtgtcttttatcaccagttccacgtcttggcacacctgcgaggtgggcttgcggttgaaagctgtgacagccactaccaggtaagcaatgacaagcaacagaacgatagaaagtagaatccttttaaccatgatatttttctgataatagttgggtgatttggggcgcatagttgtccaggtctccggctcccagcactaccaatacttcggtgtgcttttgggcgaggaggctgaggacgtcttctttcctacagatgcatttctcgatgccggggcggaggttgtcataaatcagctgactcgtcacgccgggaatcggttgctcgcgggcagggtatatctctgtcagaatcacctcgtcggatagggaaaggctgtctgcaaagtcacgatagaagtcgcgagtacgggtgtacaagtggggctggaagatgacggttatcttcttgtcttggtacaactcgcggacggacttcacgctttgggctatttcggcagggtggtgggcgtaatcgctgaggaatacaatccggtcgttcttcagcttgaagtcgaagcggcggtccactccgcggaagcttgccatgccttgcttgatttcttcgtcggtggcaccgctgagatgggcgagtgccatggcggcaacaccattctcgatgttgatactgacgggaacccccaactgaatatcgttgatgcgggtgtcaggcgccacgaagtcgatgaagatttcaccgtttccgatgcggatattctcggcatggaagtcgccttcgttgcgcgagtaggtataggtggtgacgcccggttgtacgtcggcttgcatttccagtcctttgtgcagaatcagggcgccgcccggctggataagcgtggtgtagtggcggaagctttcgagataggcttctttggtgccgtatatatccaggtggtcggggtcggtggcagtaatgacactcatccagggcgatagccagtggaaggagcggtcgaactcatccgcttcgataacggtataagggctggtggcggaaagcagcagattcgtaccgtagttcttcgaaatacctccgaggaaggcgatgcagcccacgtgtgactggtgcagcaggtgggcagccatggtgctggtggtagtcttgccatgcgtacctgccacgcacaggcctttgctgctgcgggttataatgcctaatacttgggagcgcttatgtatgtcgaaaccgttttcacggaaataggtcagttctgcatgctcttgcggcacggcgggggtatagaccacgagcgtgcttgccttgtctttgcactcctccggaataaggttgatatcctcttcgtagtgtatctgtgctccttccgtaatcagacgttctgtcagttcgctcgacgtacggtcgtagcccgctactgtctttcctttagagaggaaatagcgtatcagagcgctcatgccgatgccgccggcaccgacgaaataaacggagtggatggcttcaagcctcaccccctgcccctcccccgtagggaggggagatgagttactattgcttatatttttattcatattcaaattttttcttcaaactcttcttccaaaagtatgatattataaaaagaacgatagcagtactatctattcccccctccctacgggggagggacaaggggagaggctcttcaatacctccttcgcaataattgtcgccgagtccggcaacgctagcttggcgatattcttgctcaagtcttgcagcttctcggggttagcgattgtctccaacgccaccggcagcagcttctctttcgcttccacatccttcacatagatagctgcatccttatccaccagcgccagcgcattcttggtctgatggtcttcggccacattgggtgagggaaccaggatgaccggcttgtgcagcaggcagaactcggagatggaaccggctccggcacgtgaaatcaccagatcggcagcggcataggcgtttgccatatccttaatgaagtccgtcacatacagattcggaatggcactgatatgcgggttacgtacggcttctcccgtagtggctgtaatggcttctctgacttggtcaatgtatatcttgccagtctgccagataaactgtacgtcggggtgggtacgaatgacatccagtccggcagtcaatgtctggttgatggtacgcgctccaagactgccgcccagaatgaggatagtcttcttttccgggttcaatccgaagtactttacggcgtctgcgtgcaggatggaatgtccgagcaggttctggcgcaccggattacctgtcatgattatcttttctgccgggaagaatttttccataccttcgtaggccacgcaaatcttgcatgccttctgtgccagcagcttgttggtgacaccggcgtaggaattctgttcttgtatcagcgtgggaatacccatcatgcccgccattttcagcgtaggaccactggcatagccacctacaccgacggctacttgcgggcggaactccttgatgatgctccgtgctttccactggcttcgtatcagtttcagcagtacggagaagttcttccacagatgtttacggtcgaatccggcaacgggtaagcctataatccggtaaccggcatctggaacacgctgcatttccattcttccttcggcacctacgaagagaatctccgcgtcgggacacaactcttttatggcgttagcgatggagatggccggaaagatatgtcctccggtaccgccgccgctgatgataagcctcacccccttccccgtagggagaggggtagagttacttttggttgtatagttgttcgcctctttactcatattcttgttcttttttatttttgtattattggcatgctctccattactcaattattcttttctcccctccctacgggggaggggttgggggagaggctgttattcaaactccgcatcactgttcagtacctttgctgtcggctcggcggctgtctgtgcttcgctatcggccggttgttccgggttctcggcatttccggcatctatcagcatcggcacttgcgcatcatgcatccgctgttcctccagcttggctgtatagcggctgacactcagtatcatgccgatgtaggcacagttgatgaaagtggatgtaccacccttgctgatgagtggaagcggttgtcccgtgacgggtgccagacctacggcaaccatcatgttgaacagcgcctgcgtgacgagcagcaaggctattccggtaatgaggaaagcggggaaagtgcggtcgcattttttggcgatacggcccactcgcaccaataggcagacataaaggaacacaacgactattccgcctaccagtcccagttcctcgatgatgatggcatagatgaaatcggagaatgcctggctcagaaagtcacgctgtacggagtttcccggacccttgcctacaacgttgctcgtagctacggcaatacgggcatgtgccacttgcccgtcgccgtcgatgtcgaatttggcggcaggaacttcctccttgttggtaaagtctgcaatacgggattttacagtggtgaagcggtgccccatcggtatattttccaatgtcttgtctggcgtggccagcaggaaggcgacaaagactgttacgaatgccacaatccctcctcccagtatcagcagtttcctggcagatacccgcccgatgaacatcatcaggtagaccgttccgaagagcagcattcccgtcgagtagttttccggcaggataaggccacagacaatgcaggtaataatcatgatgcgcttaaaggctttcggacttgcaccgtcttcatcctgccctttcgagaggataaaggcggtaacgatgacgacggccatcttcgctatttccgacggctggaactgaatacccatgaaggtcatccagcgggctgcgccgtttacgcggtcgccggtaatgaatcccatcagcatcacaaaagccagcagtccgatggatatcggaagcaggaataccgggaacacctgaaaccatttataggggatgttgtgtaccagtactacaatgacggcgcctaccatcaggaggatgctgtgttgcgtaatcggtccccaatggtcgccactcttgtaggtcagcgtactggcagcactgaatacctctgtgatggagatgaggcaaaggaaaaggaaaataatccaaatcactttatcgcctttgaatatgctctttaataaatccaatgcttcgcaaattaaaaattaataattaaagaattaaaagttgccgttcttgttacggaattcgtaataggactgttacggcatctgtatcttatagtgctctgacacatgctttgaactgatcgccgcggtcctcatagctcttgaagaggtcgaaggaggcacagcaaggactgagcaacacggtttcacctttctttgccagcttgaaggctgcttctacggcatcctgcatgccggtctgcacgtcggctacgggcagtcccagacggtcgaagaaggcgtgcagcttttcgttgtgcaatcccaaatagaccagggcagagcacttttcgcgtacgaggtcttcgatttccgtgtaatcgtttcctttgtctttaccgccgaggataagtacggttttgccggtcatgctttgtagggcataccagcaggaatttacgttcgtagccttggaatcgttgatgaagctcacgccgcgtacggtggctactttctccaaccggtgttccactcccttgaagtcggacaaggctttgcggatatattctttccggatgccggccaaattggccgagatgccggcggctaacgaattgtataggttgtgtgtgccgtgcagcgccagctcctcttgctccatattgaaggctatcggttcgttgatttccacttcaccgtcttccacgtatgcgatggccccgtcttccttcacggcagcgaacgggtagagatgggcgcgcaggccatgcttgtccagctcgcgcttgatgatggggtcgtcgttccagaagataaaagcgtcttccgatgtctggttttgggtgatgcggaatttggcgtccacatatttctgcatacagtggtcgtaacggtccaagtggtctggtgtgatgttcatcagtacggcaatgttggcacggaagttatacatattgtccagctggaaggaactcagctcaatgacgtagtaatcatgctgctccgtggctacctgcaaggccaggctgttgccgatgttgccggcgaggccgacgttcaggcctgcactcttgaagatgtgataaatgagcgaggtggttgtagtctttccgttcgagccggtgatacagaccatctttgcgtcagtgtaccgtcccgcaaactctatctcagagatgatgggcgtacctttttcctttaatttcataatgagcggagcgtcgttgggaataccggggcttttcactacttcgtcagcattcagaatcagctcttctgtgtggtgtccctcttcccaggcaatgccgtatttatctagcagttccttgtatttgtctttgatggcggacatgtcggagacgaacgtgtcgaatcctttcactttggccagtacggcagcgcctgcgccgctttcgccagctcctaatactacaattctcataatgtactaatatgattaatgtgccaatgtgctaatgagctgcgctgtcgtgccgcatggcaattagcacattggcacattagcatattgaataattattatctaatctttaatgttataatcgttatcgctgccaatacaatcgtcacaatccagaagcggatggtgattttggattcgtggaacagcttgtccggtttggtgaatactacgctgcatcccggctctatcaggctcatggaagtgcggaagtggtcgtgtatcggtgttcttttgaagagacgttgtttcacgcctttccgcttgcctgccttgtagtagaggcgttgcaggatgaccgaaaggttctccaccaggaagataccgcaaaggatgggtatcagcagttccttgtgaataatgatggcgtatactgcgatgattcctccaatggtcagactgcccgtatcgcccatgaatacctgggccggataggcattgtaccacaagaagccgataagtgcaccgatgaaggcacagataaagattaccagttcttccgagccgggaatgtacatgatattcaggtagccggcatattcaatgtggctcgatacgtaggcgagtattcccaaggtcagtccgataatggcagagttccctgccgccattccgtccattccgtcattcaggttggctccgttgctgacggcggtaactacgaaaatcgtgataatcacaaacagtatccaacctgctgtctgggcatgttcacccatgaagcccactaggtcggcatagtcgaagttgttgctcttgaagaatgggatggtggtctgtgttgccttgatttccttggcggcatgcaccacttctatctgtccgtccggtttctctatttctatgttctcgcggataaccacctgcggactgaggtagagagtcagtccgacgataagtcccaagcctatctgaccgatgattttgaacttaccgtgcaggccttccttgtccttcttgaatatcttgatgtagtcgtcggcaaagcccagcgaccccagccagattgtggtaatcagcatcaatatcatataaatattgctcaatttgcccagtagtaggcaaggaatgagtatggcaaaaataatgatgacaccgcccatgctgggtactcccaccttgtttacgccgaacgggtcgatgctggcatcacgttgcgtttcagtaatctgcttgcgtttcagtagattgatgaacttatctccccagatactcgaaatgagcaatgccagaatgattgccatcaacgaacggaaggatgtatagccaaacatgcccgcaccggggaagtcatatttgtctaaccattgaaataaatagtataacatgatgttaattatttaattgtttaatgtgctaatgtgccaatatgctaattgatagtctggtatatctgctggtaaaggaatgaatatcctacatgacgcatggcaattagcacattggcatatcagcacattatctcatttaatatctctttgtcgtcaaaatggtgtttcacgcctttaatctcctgataattctcatgccccttgcctgcaacgagaatcacgtctcccggctgtgccagcatgcaggctgtcttgatggcttcgcggcggtcggtgatgctgatggttttctgcatgtcgtctttatccagtcccgccagcatgtcgttgatgatgtcctgcggctcttcaaagcgcgggttatcggaggtgatgatgacccggtcgctcaagcgggcggattctttggccatgatgggacgcttgcctttgtcgcggttgccgccggcgcccacaacggtaatcactttcccttttccttccagcactccgtgaatggcgttcaatacattgaccagggcgtctggagtatgcgcatagtccacaatggcggtgtagcctttcggtgaacggatggcatcgaagcggccggttaccggatgcagcgtgctgagggcaaccagtacatcctcttctttcttgccaagcaatacggcagtaccgaataccgccagcaggttgtaggcattgaactttccgatgaaacgtactgccagttcgtgattgttgaagtcgagcaacattccctcgaaatgagactccaagactttgcctttgaagtcgctaagactacgcaaagagtaggtgtataccttcgaacgggtattctgcgtcatcacaagtccgttcttgtcatccaggttggtcaggctgaaagctccttttggcagttcgtcgaagaactttttcttggctttgaggtagttctccaccgttttatgataatccagatggtcgcgggtcagattagtgaaaataccgccggcaaacttcagaccgctgatgcgcttttgggcaatggaatgggaactgacttccatgaaggcatacttgcagccggaatcggccatttcgccaagcaggcggttcagggttatcgggtctggggtggtgtgttcggtcggtacgggcaggtcgtcgatgtaattgcatacagtggaaaccagtccgaccttgtagccgaaatagcggaaagtattatataataaggtggcaacggttgtttttccgttggttccggtcacgccgatgagttccatcttggatgtagggtcgccatagaaagtggtagccactttccctacggcatcttcactgtctttcacctgaatgtaggtgatgccggccttaagctcttccggcaattcttcacacaatactgcaacagcccctttatcgatggcagccggaatataggcatgcccgtcggtctgcgtaccacgcatggccatgaacagatgtccggttcctatcaggcgggaatctatattcacccccgttatctccatgcttgtacttccggtaatctggaccggctgtattgtttgcaacaaatcacttaatctcataccttattatatatagtgtatatccaaatcttgtttattctcatgttaacgtagtgtcagggctatggtttgtcctttcactatccggctaccgcttgctatggactggttcctcacccgtcctacgccgtttagccttactttcagtcctttactctctaaaaggtagacagcatctttcgctcccatacctaccacgctgggcacggtgcccgaggccggttcctggtcttgcaggatgactgccgacggagctgcttgtgtatgcccccactgttcctttttcttttgtccggcgaactgtttctgaacgggcactttcaaatcattcagtacaaggagtgcttcgttcatctctccggctttcacgggaggaatcacattggtggtactgtctatggcactgcgtatgtcaaaacgcaggtctttggcataaactctttctgctattttcccgaagacactacctgccatcagaccgcctgaagctggtaacccaggcttctggatggaaacgatgcaactgtatttgggtgcttccgaggggaaatatccgcagaaacttacaaggtagttcacccgtcccgacttatatccggcggctccttgagaaatctgtgccgtacccgtcttgcccgatacggagaactgtttgctgccggcaggttttgccaatccttgcgataccactttccgaaggatttcgcggatttgtgtcagggtatggtcggagcatatcttgggattgattacttccgtaggatattctttcactacctcaccgtcctttaccgctgctttcacaaatttggggcgtaccatgaccccgttgttggctatggcattgtagaaggtcagtatgtttatgggaggtacctgggtttcgtaaccgatactcatccacggcaaagtcgttttggcaaaataacgctctttaggccctttgatgttgggtttcccttcaccgggtatttgcagatgaagcggctggtcgatgctcatgcgcttcaaaccgtccacgaacttctgcggattatccttgtagtgcttgtcgatgaggtaggagacacccacattggaagaaacttccagaatacgtgtcacatctatctttccgtaacctccccggtgccagttgtggtccctcatcttgctgccgtacatattcataataccgttgcccgtgtctacctcggtatccggggttatcttgccatcttccagtgccaccataatggaggctgtcttgaaggtggagcccggttccaacatatcgctgatggcattactgttcatttcgtagtaattgccgtctccggctttcatcatgttgacaatggcctttacttctccggtagccacttccatcagtacggctaccccgacgttggcattgatttccttcaacttgtctaccagggctttttcgcagatgtcctgcatgcctacgtcgagggtggatatgatgtcacaaccgtctaccgggggaaggtctacgatattcaggtatttattcatcaccttctgacggtgggtaataccgttccgtcctttcagcagggtgtcgaaggccagttcaatgccgttacgggctcccatggctgtatcggcatagagacggcccagggtttgggctgccaaagaaccgaacggctttttacgctggttgtatatctgttcgtggaacccgcctctgtacttgttcattttgaatacgggtaaccgcttggcttccttatactgaatgtaagagatgcgccggttgcggttgggaagaatgttgtagttccggctcttcatctcccgccccttgcgcagatggcttttgaaggtggcggcactgatgtccggaaaaatctgatgaagcccgatacagatggaatcgaaattggctttccagatagaatccttgcgctgctggtcctttttgcggcgcttctcgtccctttcgccggacatgaagtccatatatattttatattccggcagcgaacttgccatcagtttgccatccgaggacaggatatttccccggttgggcttcaccgttacattctcttttacgaagcggtcggctacatcgtgccagtactgtcgctcggcaaacataatcatggcgcctttcacaacaatagctatccccaccaaccccatgagtaggacgacgaagaagtaacgggtcattatgttttttttatttacagccaatgttatttacgatttaacgatttacgatgtactattgaaattactttaatcctcaattctccattattttagtaagtacggtggattagtggaagtctgcaaatcgctttctttggtggcgatgtattcctcgatgcgcgattggcggctccgctccatcaattccgaactgcgtgtcagggcatcgtacttgatgtctatcagctcttttttaagattgtctatctctatcagttgcagttggcattcgtaacggttgttgatgtaaataatgataagcaccatgataaggaacaacaatccggcttggcggcggaagaagtctgtggccagaatgtcgcctccgatgatgttcttcagtgaggtgcgttttttcaccttttccgtattcttttcttcttgcttcttttccattgctagtcactaatcattcattattctttctgcaattctcagcttggcgctgcgcgaacgcggattgcgctctatctctttctcgtccggtacaatcactttgttgttgactagccggaacggggtcaatacgttcccgaaaaaatctttttcggccttgccttccacgttgccggttttcatgatattcttcaccatacggtcttccagggagtgataggttatcaccaccaggcggcctcccggctttagcgcttctgttgccgcatacagcatttctttcagtgcttccatttcctggtttacctcaatgcgcaatgcctggaatacttttgccagttctttcttctcgcgttcgcggccgaagagtggtttgacgatttccagaaattcgccgatggtggcaattctctgcgtagcccgtgccttaacgatgacagatgccagtttccggctgttcttcagctcgccgtacagataaaaaatatcggccagcttttcttcttcgtaggtattcacgatgtcggcagcggttaggccggcacgcttgttcatacgcatatccagtgccccgtcgaagcggaaggagaatccccgttcgctgtcatcaaagtgatgggaagatacgccgaggtcggcaagtatggcatccactttttcgatgccgtgatagcgtaggaagttgtgcaggtagcggaagttgctgcgtacgaatgtaaaatgcgggttgtttacaatgttacgttccgcatcctcgtcctggtcgaagctcagcagccggccgccgtcttccaggcgggacagtatctcgcgcgaatgtcctcctccaccaaacgttacgtctacatacgtgccgtccggacggatgttcattgcatctacgctcggcatcagcaatacggggatgtgatatgttgtttcttctttcatcatctgttgtttatagcttattttcgtcacaacaaatattttcgtctcccagcagttcttcaagagcctcgctgaactcgtcggggttcatgaatggttggtcggcacgttccttagcccagatttctattgtgttgtccacaccaatgaagcggacatcactttgtatacccgccatttgcaggtaacgttttgggagcaggatgcgtccgttcccgtcaggggtcatgacttccgcgtcacttacgaactggcggaaaatcatttgttgtttggcgttccatttattcagccggcagcgaagttggttttgagtggcaaaccatacactttccgggtagagtaccaggcaatcctgatacacgtccttacgcaacacgagtctttcttcagaagcggcttgcagctgtttccggaaggtggccgggatgaaaactcttccttttgcatccgccttagcctcgatattacctaaaaattgtatcatttctcaccttattataataagcgacggtaaaaatacacatttccccacaattccccacaatcttttaactaaaatcttaggaagaagttttcaacaccttgttgatagcttattcatttgataatgaagctgcttttgaaacgctttgctggtgggggattcgtgtagtctcttttgaaaagattcggttgaggatgacggtctttggtttgaaagtcgcttgttggtggaatggtgtcttgggtgggaaacttctttcccagctttgcggatatctaaaccaagacttggtttctctatccccaggcttggtttggaaaaaccaaagtttgggataaagctctttcttaactctttcttgttttagtattaacttctgaaactttttttgttaacttcccgtctattttgtgaacgttactacttaccggaagatgatgggagggaggagtgataatattccccctggagtggttgattattacattcatccacagaatccaggggggataaatgtttttttactgtatgctgttcagcaagtctagcttgccctcgttcaccagttttagaatgagttcgccaaacaatgtgttttgccatgcaaaccaggcgcgggtgaacttggcgggattgtctttgtggaaagactcgtgcataaagccggttccggcttctgtatccatcaacatcttcacgcaagttttaatctcttcatcgttctggcttgtgaaggctttcatcatgatgctcatcggccaaatcatgtcgtagccgatgtgcggacctccaatgccttcgcctgccgtacctttgaagaagtatgggttatcctcgctccatacgaaacgacgggtgttctggtaaataggatcgttgatgtccacatcgcccagatagggcagtgcgataaggctcggtacattggcgtcgtccatcagaaggtggttgccgaaaccgtctacctcgaaggcatagatggtgccgtatttgggatggttgtaggtagcgtattttcgtagggcggtttctacttctccggccaggtcggtacattcttttgcaagctccgggcggttattgacttcagtcagaatctcggctgccttacgcagcgaagatacggcgaagaagttggagggtatcaggaattggaaggtggtggcgtcatcggaagggcggaaagaagatgcaatcagtccgaccggtttcaccggattgccccagccgtcgttggtcatcgtgtccagtgcgcgttcagttacccgctggaaatggtaggaaccgcgtccgtcacggcgctgttggtcgcggaaggtggtcaggatgttttggattgcttttatccactcggcatcgaagatgcttgtatcaccggtcgttttccagtaatggtaggcaaggcgtagcggataacacagtgaatcgatttcccatttacgctcgtgcatctcgtcgttcatgtcggtaaggtcggttttccagtgtccgtcggggatggggccgtcgttgaaggcgttggcaaacgggtctacattaatcagcttgaattggcggttgatgactcctgcaagcatcgtcttcagttccttgtcttcattggccagctgtacgtagggccacacctgcgcacctgagtcgcggagccacatggcatggatatctccggtgtagacaaatgtgtcgggcttcccgtctttcttgtccttgcggaaatggacggtggtgtccagcgtgttgggaaagcagttagtgaacatccatgacagcttctgatttttcagcagctgctgtatccgttgaatttgttcttctacggctttggaacagaacagtcgttttgattctaccggtcggttgtctttcttgatagcgtcggaggcgcatacgtggttactcatggccggctgtacggcaaaaatggcaggagtagccattgtcattgctgcaaatgtgcaggctgtaatgattgtctgtttcttcatgttgtttattaattactcggtttttttttaggtatcttggtttgtgtcccatgattgcccaaagataagcatatttacttttttatccggccaattaataaacaattcttaggttgccgtattctcttatctgaaatctttcagttcctgttgcagtttctggcgggtaaagaagatgcggctctttactgttccaagtgggaggttcagcttttctgcgatttcacggtacttgaaaccggagacatgcatggagaaaggtatcttgtactcacgtggcaaggcattgacaatgcggtgcatttccttcaggtcgtaggcgccttctgtgctgtcgagtgtgaggtcgtgcggcgtgttcagatgatagagattgtctgtggtatctacaaatgtctggtcacgtaccactttacggtaattgttgatgaaaatattacgcatgatggtatatatccatcctttaaagttggtatcaggtgtgtacttctcttcattgtccagagctttcagggatgtctcttgaagcaggtcgttggcctcttcgcggtcggaggttaatttatatgcaaagcgtaataagtcgttttgaactccgagtaggtcttgggtaaatgttctattattcataatggatgttttttaaattattgttcgttttattgatgatgcaaagctacggatgatttctctttttgatagacggaaatcaaactctctttggggtaaaatctaacaattggcagttttcgggtggctttggttagctttcagtgcctcggataggtggaaaagtgggatgtagccagagattgctatcctgatttttgtaaataatattatcgcaaagcgtaacggcttgaatgagtttgtgtacgaaatacaaggggcgagaccatgaaaggcagacgcgggattgtcccggcctgcctttctctcttttgatacaactaaaatctgtactcttcttaatttatggaaatcactggttttatatgctgagtgcttaaacaaaatccttcaagtcttgttgtagtttttggcgggtgaagtaaatgcggctctttaccgtgcctaagggcaaccctagcttctctgcaatttcgcggtatttgaagccggagacatgcatggagaagggaatcttgtactcccgtggaagggcgttgacaatgcggtgcatctctttcaggtcatatgcgctttctgtgctttcaaaagcggcgtcgcgcggcaggttcaggtgatagagattgtccgtggtatccacgaaagtctggtcacgcaccactttgcggtaattgttgatgaagatattgcgcatgatggtgtatatccatcctttgaaattagtatcgggcgtatacttctcttcgttatccagagctttcagggatgtttcctgcaagaggtcgttggcttcttcacggtcggaagtaagtttgtatgcaaaacgcaataaatcgtcttgaattccgagcaggtcttttttaaatgttatattgttcatatgtgctatgttttttttcgttaatcttgatattgcaagtttacggaagttttctctttcaggcagacggatttcaaacacactttaggggaaaaactatcaattgacagtttttaggtgctatttgatagatttcgggtgcagttttctgtcatttttttgcgattaattaaaaagatgagttaattttgcgcattcatttcatcaaaagaagaatggctgacgactctttatttttgattgacatagacaagatacttcgggaaaaggctccgaagcagtctaagtatatccccaagttcgtggtttcttatttgaagcatatcgttcatcaagaggaattgaatgtctttttgcgggagtcgaaagataaagtcggtgtagatttcctgaaagcttgtctggagttccttgatgccaatattgtggtaaagggggaggaaaatctgcctaaagaagggctttatacttttgtgtccaaccatcccctgggtgggcaggatggagtggcactgggttatgtcctgggctccttttatggtggcaaggtgaaatatatggtcaacgacctgctgatgaacctgcacggactggcgccgctttgcatccccatcaacaagacgggaaagcaggccaaagacttcccgagaatggtggaggcgggatttgcttcggacaatcagctcatcatgtttcccgcagggctttgttcgcgtaggcagaatggggtcatccgtgacttggattggaaaaagacctttatcgtgaagagtgtcgaagcccaccgtgatgtcgttcctatccacttcgaggggcggaattccaacttcttttataatcttgccaatctttgtaagatattgggtatcaagttcaatatcgccatgctttacctggcagatgaaatgctgaagaatcgtcataaaacatttaccatcaccatagggaagcctatcccctggcaaactttcgacaaatcgaaaagcccggccggatgggcgcaatatgtgaaggatattgtatataaattgtagagagaccgtatttatattaaagaagaactactaacagaaaaatatggaagatgttattgcaccgataagcaaggagctgttgaaagcggagttgactgaggaaaagcgtctgcgcatgaccaatagaagtcataatcagatatatatcattactgcccaagactctccgaatacaatgaaggagatcggccgtttgcgcgagattgcattccgtgctgcgggaggaggaacgggcaagtctatggatattgatgaatatgacatcatggacaacccgtacaagcagttgattgtctggaatccggaagcagaagaaattttgggtggataccgttatatcttaggtacggatgtgcgttttgatgaacatggtgcccctattctggcaactgcccatatgtttaacttttcggataagtttttgaaggactatcttcctacgaccatcgagttaggacgttcgttcgttacgttggagtatcagtctacgcgtgcagacagtaaaggtctgtttgcgttggataatctgtgggatggtttgggcgcactgaccgtagtcatgcccaatgtgaagtatttcttcggaaaggtgactatgtatcccagctatcatcgtcagagccgtgataagattctttatttccttcggaaacattttgcggataaggacaacctgattactccgatgaaaccgttgcttctggagtcggacgagaatgaattggcggctctcttctgtaaagactcttttaaggaagactataagattttgaattgtgaaatccgtaaggcggggtataatattcccccgctggtgaatgcctatatgagtctcagccctaccatgcgtatgttcggtacagccatcaattacggtttcggagatgtggaggaaacgggtatcctaattgccgtagacgagattttggcagaaaagcgcatccgccacatcgagtcgttcatagcgagcgaaccggaggcgtgcaagcttacgtcgggagcaaataaggttgtatcataggactatccggaggaatgtttgtcgtctgttataccgctggcaagctattcccgtttattttcctatataaatcgagtgcaaatacatccgtcattccggagatgtaatccaataccgcctgtattctttcgtagagtgcaggcgcttttatgttgtactggcccgatacgcgattgatgagcagttgcgaatatgccttttccggagaacgcacggcgtcaatcatcagttcgagcagggtactgatgatgcggaaaccggcaagttcaatgtccagtacatcgcgtgaacggtaaatcctcttcagggagatgtctgcacagtgcttgtaggcattggctggtacctcggatatatggttgatgaggcttccttcaaattctcctttcagaatcttttcttcattgtctacaaaggcttgcacgcattcgccgataagcagtccgataacgctggaacgcagataggctatttgttcattggtgtcacttactatctccatcgttttgagccggtgtgcttggcgctctttcgagaaataagaaagaagcaactctttggtttcttgtgtagtcagaattttcagtttgtgagcatcctcaatatccatcatctggtagcagatgtcatcggcggcttccaccagatagaccagcgggtggcgggcatatttcaacggggcatcgttctgcttctccatacccaactcttctgctatgcggcgaaaactttcttcctctgtgatgaagaaaccgaattttgactttttgcctgcaagactcgatgaaaagggatatttcacgatgcttgccaaggtggagtaggtgagtacaaatcctccctgtcgccttccctcaaactggtgggtaagcaggcggaacgcatttgcattcccttcaaagtgggtaaggtcctcccattgggaaggtgtcagttggcccttcagggacattccttttccttcagaaaaaaaggtggaaatagctcgttctcccgaatgtccgaaaggaggatttcccaagtcgtgtgccaggcaggcggccgaaactatggagcctatttcggtgaggtagctgccttgcagttccgggtggcgggcaatgagaactttcgatacatcgttgcctaatgagcggcctacgcatgatacttccaagctgtgtgtcaatcggttgtggacgaatacactaccgggaagagggaatacctgggttttgttctgcagacggcggaagggggcagagaagataaggcggtcatagtcacgttggaattccgagcggttttcatggcgttcctggtgaaactcttccagtccgaagcgtttggcagatatgagcgtattccaattcatcatgatgttatttgagatttgacgatttactatttacgattgaagttactattatttaactgcaaatgtatcactattttgtataaaaagccgtattttcgcccaagtttatagtaaaaggaagatgaattgcgaaacttgaattactcgaattgtaagaatagaagtagccccaatcgtaaatagtaaatcgtcaaatcgtaaataacatcatgttgaacgtacaaatcatcaataaatcaaagcatccgcttccggcttatgccactgagctgtctgcaggaatggatatccgtgcaaaccttaatgaacctatttcgctggctccgatgcagcggtgtctggtgcctactggcctttatatcgctcttcctgaaggatttgaggcgcaagtgcgtccgcgtagcggattggccattaagaaggggattaccgtgctgaactcccctggaacgattgatgccgattaccgtggtgaagtttgtattattctcgtcaacctttctgcagaaaccttcgtcatcgaagatggggagaggattgcacaaatggtgatagcgcgtcacgaacaagctctttggcaggaagtggaagtgctggatgagacggagcgcggtgccggtggcttcgggcatacgggtaaaaaatgaatggatattgttccgttttacgggttaagaatttataattaaatagatgagaatcagagtaaaaataatacttgcgttgttgataggtaccttctgctttactacgtacggagtgcaggctgccaacgttcaagcttctaaggagaaaatgagcgggtatggtcggtctgaaaaggcacggaaggaattgaagaaacggaagaagtcgaagaaagccgacgtttcgcccgtaaaggagcttacccccgaacagcagcgccgttacgactacttctttcttgaagccgcccgtctgaaagtccagaaagactatgatgcggctttcgatgtcctgcaacattgcctgacgataaacccgaacgcatcatcggctttgtatgagatggcccagtattatatgtacctcaagcaggtaccgttgggacaagccgccttggaaaaggcggtggagaatgctcccgataattactggtatgcccaggggcttgccaatctgtatatgcagcaaaacgaaacggagaaagccgctgccttgttggaaaatatggcggtacgtttctcggataagctggacccgctatacaacttgctggagatttacaaccgccaggaagagtatgacaaagttatcggtatactgaacaagctcgaggaacggatgggcaagaatgaacagctcagtatggagaagttccgcatctatctgcaaaagaaggacgacaagagcgcctttcatgaaatagaaagtctggtagaagagtatcccaacgatatgcgctatcaggttgtgctgggggatgtctatatgcagaacgggaaaaagcaggaagcttatgagatttacaagaaggtgctggccgaagagccggacaatgcaatggccatgtactcattggcttcttactacgaagagaccggacagaaggagctgtatgaacagcaattggacacgctgttgctgaacaagaaagtggcttcggacaccaaactgaatgtgatgcggcagttcatcgtgcagaatgagcaggcaggcaaggacagtacacgtgtcattacgctcttcaaccgcatcatggagcaggagcccgatgaggcgcaattacctttgctgtatgcccaatatcttctttccaaaggaatgaacaaggaggcagggccggttctgcgccaggttctggcgatagaccctaccaacacagcggctcgtatgacattgctgggggaagctgtgcgccaggaggattacaaggaaataatgaatttgtgcgaagccggtgtggagtccaatcccgatatgttggagttctatttctatctggccattgcctacaaccaggcggaacggacggatgatgcccttgccatctgtcaaaaggctttgtcgcacgtcaaggacgacagcaagaaggaggtcgtatcagatttttatgccattatcggtgatgcttatcacaccaagaatctgcatgcggaagcttatgcggcttatgattccgctttggtgtacaatccttcaaacatcggtgccttgaataactacgcatattatctttccgtggagcgccgcgacttggacaaggcggaagagatgagctacaagacagtgaaagccgagccgaacaattccacctatctcgatacatatgcatggatattgtttgttaaaggtaattatgccgaggcgcgtctctacatagatgaggcgataaagaatgataaagatagcagtgacgtggtcttggaacattgcggagatatctattacatgactggcgatgcggaaggtgccttgaaatactggaaacaagcctgggataagggcaatcgctctgatacgttgaaacagaaaatacaaaaaaagaaatatatatcagatgaaactaaacctgctgaatgatatggcaaggatatgccgcctgttgtccttgctgttgttgctggctgtggggcttgccggttgcaagacttcgcgtcactcaagttctctgtccggagaatctgcctgcctttcctccaaagtgcagctgacggtaccccataaagatgccacccttactgtgaacggtacgatgaagttgaagaaggaagaatgcatgcagattttctttctgatgccgatacttcgtacggaggtggcacgtatggaagtcaccccggatgagattctgttggtagaccgtatgggaaaacgttatgtccgtgcaacacgtaaggaactgaaggatgtgctgcccaagaaggcggattttgcccatttggagaaactgctttatgctgcttccaaacccaatggcaagaaggtgcttaccggcaaggaactcgggataccctctctggaaaagggaaagattgaactttccaacttctcggataagccttttgcactgactcctacccagctctcacagaaatataaagaggtggagctggaagaactgctggaaatgctgatggacctttgattagttgataattgtcagataatccctcataacttataactcataacttatgaagcttctccttctcttctttctcctccttttgccggtttctccgctccttgcccagtccaacaagctgattaaggaactggaaagcaagcgtggtgccttacagaaacagatagcagagtcggaaacgctgttgataaccaccaagaaggatgtgggaagccagttgaacggtcttgctgcactgaccggacagatagaagagcgcaaacgctatattctgactatcaataatgatgtggaatccatagagcgcgagttgtcttcattagaacgtcagttgacccgcctgcaacgtgacctaagggacaagaagaagaaatacgaatcgtccgttcaatatttgtataagaaccgctccattgaagagaagctgatgttcattttctctgccaagagcctggcacagacctatcgacgcatgcgctatgtacgtgaatatgctacttatcagcgcctgcaaggcgaggaagtgttgaaaaagcaggagcaggtgaaccgtaagaagactgagcttcagcaagtgaaggttgccaaggaaggattgttgaaagaacgtgaagaggagaaagtcaagctggaagcgcaggagaaggaacaaaagttgttggtagccaatctgaaaaagaaacagcggggattgcagaacgaactgaataagaaacgccgtgaagccaatcagctcaatgcacgcattgaccgtctgatagcggaagaaatagagaaagcgcgtaagcgtgcggcagaagaagcgcgccgtgaggcagccgcacgtaaaaaggctggtgagaaaaccgaaaaaacggcaactgcctctacgcccgcaaagccgaaggcacagcctttggaaacttactccatgagtaaggcagaccgtgaattatcagggaactttgctaataatcgcggtaagttgccgatgcccatcaccggagcgtatatcattaccagccattacggccagtattctgtggaaggtttgcgcaatgtcaagctggacaataagggcattgatatacaagggaaaccgggtgcccaagcccgtgccatcttcaatggtaaagtggcggctgtctttaaactgaacggactgttcaatatccttgtccgtcacgggaattatatatcagtctattgcaacttgtcatcggcctcggtgaagcagggcgatgatgttgccaccaaacagactctcggacaaatcttctcggatggggccgacaatggtcgtacggtgctacacttccaattgaggaaagagaaggaaaaactgaatccggagccgtggctgaacagataatgataatttaaatttttactccttccagcagctccagatacatccctatcgcctcctctatctccttgacaaagataaattcatcggcagtgtgtgaacgggcacttttccccggtcccatcttcagagaagggaatggcatcagtgcctggtcggacaaggtcggtgagccgaaaggagtacgtttcatggcaatagccttttgcactaccggatgctccggagctacgtgtgaagagcttagccggaaggagcgggctttggcttcacacgtgatgtgtttctgtatttcatcgaatagctcctgattgctataacactcgttgctgcgaatgtctacgacaaaagtacaacggtcgggaatgacgttatgctgtgtaccggcgtttaccatggttacgctcatcttcacgggacccagcagggaagattcttttgggaaacggtaatcacgaaaccaggcaatatcatccaataccttatatatagcattatctccctcgtttcgggcagcatgtcccgattttccggtagcagttacgtccagcaccatcaatcctttttctgcaatggcaggttgcatctctgtcggctcgcctacaatggcaaactgtatgggagggagttccggcaatacgcattctattccccccttgcctgatacttcctcctcacacgaggcaagatatatcagattgtaggcctgagtggtgcggcacaatgtcaggaatacttgcagcaggctgactacactggctccggcatcgttgctgcccagcccgtagagctttccattactttccagcgttggtttgaaaggatctttccgccacccgttgacgggttttacggtgtcgatatgggaattcagcagcaaggtcggtttctttaagtcgaacatcgggctgaggcaccatacattgttgcctttacgtcctgttgccatgccttgcatttcgatatagttctgcagataatctgccgccttctcctcgtcgcggctcaaggaaggaatggctatcagtgatttgagcaatccgattgcttcggaagttaaagtcggtatatcgtaaatcatattcggtaaataaataatctggccgcaaacttacggataaaaaatgaaaaggacgccaaaccgacgtcctttctgttttttcaatattgtttagaagaagcaactgagtgatatcatcaagttgcggtttttgttgcctgaatctttaatgttctctaccagtccccagtcataaccgatggaaatctgatatttctgactgaattcgactccggcttttaatccgagaccgaaatcaaaacgcttcatggcatcatccccgaatacattggtggagttatcatcaaactcatattcgtcaagaatatctccttctgccttggctttgccaaaaagaccgatggctaaataaggaccggcattgccgaatatggcaaagttctcattcactgcatatttatagccaatgtgtacaggaatttccaggtagtagggattgaacttgatagaagcagcagagcctccgtctattttggctcctttcagcgtaagtaatgcacccatatcgaggtagactccttctgaaatttgaggcaatcctacttcagcctttaccccagcatgaaagcctattttactgtcgaaaccggtaatggagaagttactggagttcatgccgactgttgctccccatctgaggttgtcttgagcattgatgcttgctaaacctatggtcagcatagccattaaaagcaatacttttttcatgttcattgaatttgatttagtttgtatatcaccacaaatatatagatatttaatatatttctattgttttaatggtaaagaaagtatcttttgtggataatttgctaacggatggtcggatactttaaaggtaaagtttgaataattacccgctaatatcaaattagtttcaaatgaaaccactacctttgtaccgtatttaccaatatcaaaagttatgacttatcatcatttatctgtcctggtgcatcgccaggcagagaagtatggagacaaaatagccctgaaatacagggactatgaaactgcacaatggatacccatctcttggaaagagttctcacagactgtacgccggactgccaatgcaatggtggctttgggaatagagccacaagagaatatcggtatcttctcgcagaataaacccgaatgtctctttactgatttcggtgcattcgccaaccgggcggtgactatacctttgtatgctaccagctcaccggcccaggcacagtatatcatcaacgatgcacagatacgttatctgtttgtaggcgagcagttccagtacgatgccgctttcagcgtgttcggattttgccagtctctgcagcagctcatcatcttcgaccgtgctgtggtgaaagatccgcgcgacatgacttccatctattttgatgaatttatggcaatggatgaagagttgcagcacaatgccattgtagaagaacgtacagcagctgcctcagatgatgacctcgccaatatcctttatacttccggtactaccggtgagccgaaaggtgtcatgctccatcatttcaattatagagaggctttccgcattcatgatatccgattgcctttcatgacagaccaggatgtttccatgaacttccttccgctgacccatgtattcgaaaaggcatggacctacctttgtatacatcggggagtgcaggtctgcatcaatctccgtccacaagatatccaaactactattaaagagatacgccctacactgatgtgcagtgtaccccgtttttgggagaaagtctatgccggtgtgcaggagaagatttcccaggaaaccggtctgcgtaaggcgatgatgttggatgccatcaaggtgggcaggacgcataacattgattatttgcgccaaggaaagactcctccgatgatgcttcatctgaaatacaagttctacgaaaagaccatttatgctctgctgaagaagacgataggtattgagaacggtaatttctttcctacggcaggtgctgctgtgcccgatgaaatctgcgagtttgtgcattctgtaggtataaacatggtggtgggctatggtctgacggaatctacggctaccgtttcctgcttcctcaacgaaggctatgagattggttccgtaggtacggtgatgcctgatgtggaggtgaagattggcgagaacaacgagatacttcttcgtggtaagactatcactaccggctattacaagaaaccggaggcaacggctgctgccatcgaccgtaacggttggttccacacgggtgatgccggttatttgaaggatagccatctgtatctgacggagcgtatcaaagacttattcaagacctccaacggaaaatacatttcgccgcaggcattggaaacgaagctggctattgaccgttacattgaccagattgctgtcattgccgatgagcgtaagtttgtttccgctttgatagttcccgtttatggctttgtgaaggattatgccaaggagaaaggcattgcatacaacaatatggatgagttactgcaacattccaagatacaagcgttgttccgtgcccgtatcgataccttgcagcaacagttcgcccattacgagcaagtgaagcgcttcacgctcctgaccgaaccgttcagcatggagcgtggcgagctgacgaacacgctgaagctgaaacgctctgtagtggcaaagaactacaaggggctgattgacaagatgtacgaggaatagatttccatttgtttgtttttgaaccgtccgacttggagtgaattattttcattccgggccggacggtttgttttatgtatggacttgcccttggcagataggactctcgagtatgtgcacgttagttaggcttaaaaaacagcctggtagataaatggggatttatcatttcaaaacagcttcttcaaagataaaggggaagaaccgtctgtcatctgtcacgggattcaagcacgtagtccggaacgctccccttgttcagtccgtctttccccgttactttatccctcaaacgcttggtgtctgtccccgaaacagcctttgttcattgtcggctcactcgggtgaacaattccgttcactatagtgaacgagtcagaccactatagtgagccgctcagaaactcaaagcctctataagacaaagaagcggacacaacaagagaaagaaggggacgagacaagagaaagcaagggaacgggacagaccgaacaccggtgagggcaaaatttgccctcaccctttttatttgccctcactcacccatgtaatgccgatgaacagggcggttcgggaagtgagtgagggcggtgagggcaacattaagaaaatcgtattagtttttccttcttcttccgaacccgattaacttttattagcaaagaaacttctgtttctcgatagggttgcggttctctacccggttttatatacgaagcttaaaaagaaatctgcagaataagagacattttaataagctcgagtattaaccgtaacattctaatagcctatgtagcatacaaaaagaaacaaatgagattgacattcaaccctgcttgtcaatcggaaagacagaccccatcagaatctgtttattaacttaacacacatttaatctaatatttattttccgaaaaacagcttatgaaaaaaagaattatgctgaccttggtttgcctgctggcagccatcggttgggtagcagcccaaaattcccccattaccggtatcgttatttcagctgaggacaatgaaccgattatcggagcttccgtattggtaaaaggaagcactaccggagccgtaacagacttagacggcaaattcactattacagatgcgcccgcaggtgcgaaaatcctgcaagtgtctttcgtaggtatgataacacaagaagttcccgtcactccggggacgataagagtcacattgaagaatgatgccaaattgctggacgaagtggtggtaacggcattgggtatcgcaaagaaagaaaaatcactgacgtactctacccaggtggtaaacggtgatgaactggcacgtgtgaaagaccccaatatgatgaatgcattggccggtaagacggcaggtgtgcagattaataagagttcttccggtttgggaggttcttccaaagtgattatccgtggtaaccgttcggtaagcggaagtaaccagccgttgtatgtaatagacggtgtaccgttcggttcatctaccaacgaaaatacctcaactactatcggcggagacaacgacagtggtaactacgaccgtggcgacggtatttccaatctgaatcccgatgatattgagagcatgaacatattgaaaggccctgccgctgctgcactttacggtagttcggctgccaatggtgtggtgattattaccactaagaagggcaaggaaggacgcgccagtatcagtttcaataccagcaccactttcgatatagctgcatacggtattcccgaattccagaatcactatacgggtgtgtcaaccagttggggcagtgatatcaaaggtagtcccgactatacagacgatttcttcaaaacaggtgtcactactatcaactcgctctcgttgagcatgggttcgcaagctatgcaaacttacttttcctatgctaatacttacggcaagggcgtggtggaaggtaatagcttggtgaagcataatttcaattttcgcgaaactgccaacttcctcaataacaaactgactgttgatgccaatatcaatgcgatgtatcaaagggggaacaaccgtactacttcgggaggttattacatgaatcctttggtaggtctttatcacttcccgcgtggtggtgttgaaggtggaaaggactttaactactacaaagataattatcagattcttaatgccggtcgtaacataatggaccagaactggtataaatctcaaggtactgatatggagcagaatccctattggttgattaataaggttccgaatgaggatacccgttatcgtacattgttgaatctgagtgtgaagtataagttcaatgacctgttcagtatacaggctcgtggtagtgccgactatgttgtagacaagaataatacacgtatgtatgcaggtaccagcccggtgttgtgtggtatgaatccggctggaacaggaactaacggtcgttacatctacggtgaatcaagtagcctttcttcttatggggatgttttgtttacttatcaacagcaattcactaacttcagtgtcaatgcttcggtaggtgccagcatcaacgattatacaggaaacggtacaggtttcgattcctatccgggtatactctctgtgcccaacgtattcactatgcagaactgctccttgaacaagggctcattgaccgattggaaaacccatactcaaagccagagtgtgttcttcaccggtcaggtaggcttcaaagatcagatttatgtggacgtgacagcacgtaacgactggacttcaacattggcatttaccaaatacaaaaacaaaggctttttctatccgtcagtaggtgtgacatggttgctgaacgaaacattgaaattaccttcttggattgatttaggtaagattcgcggtgcatggtcaaaggtgggtaacggtttgaatacttatacttcaaatcctctcaactccattacaaagagtggtagcatcaatttcaacagtacagctccgtttgcagaactgaaaccggaaatgactacttccattgagtttggtactgagtggcgctttttcaatagccgcttggagttcgacttcacttattataagactaatacaaagaatcaactctttacgttggatgctccgtcaggttcacaatacgcccgatattacatcaatgccggtgatattcagaataccggtgtcgaagttatgttgaatggaactcctgtcatgactaaggatttccgctggaaaaccggtgttaattttgcaaccaataagaacgaagcaaaggcactggctggtgatgactttggttattttacatttagcggtggcgaaagtaacaatgtatggagtcgtttagaagtaggtggttcgtttggtgacatttacggtactacttttgtacgtgacgaaaaaggcaatattcagtatgaacctgcaaaagaaggacaaaaagatagtgatagacttccattggtggataagacaaatccggtgaaactgggtaattctactcctgattttaacttggggtggagcaatacaatcacgtggaaggacttctctctttacttcttgattgatggacgttttggaggtgaagtgatgtctttgacggaagccgacctcgatcagcagggagtaagcaaggcaacgggtgatgctcgtgaccgtggttacgtgatgctggaaggccgtcaaattacagatgtggaaggcttctataatcaggttggtggccgtgcgggtgtgaccgagcattatatgtacagtgctaccaacatacgtttgcgcgaactttccattggctatagtctgcctcaggcttggttggcaaagactggtgtcattaagaacgcacaggtttcacttgtaggccgcaacctgttcttcttcaagaacaatgctccatatgatcctgatggcatgctttctaccagcaaccgtctgcaaggagttgatgtgtttggtatgcctaccaaccgttcgattgggttcaacttgaaagttaatttttaaacagtagatatgattatgaaaaatatatttagacttacagctgtagcgctgctggcagctaccttattctcggcatgtacgggagcgttcgaggatatgaacactaatccgaagggagtgagcgatgaagaactaaaacaagataacaactacattggtatgcacttcattcccatgatgcagtctatctattataataaaaatgcaggtgtcaatgtatgggaatatcagcttattcaaaatttgaatgccgatttgtggtcaggctatatcagtacggctactgcatttgccggcaatgtaagtaatgtgacctatgccatgaatgcaggatggaatgacaactgttgggattatgcttatagaaacgtaatggtggaaagcttgaaaatcaccaacaagtgcaaagacgatatggagacgtatgcccatttcgaggctatcaataccatctgccgcgtaatagctatgtcgcgtcttgccgaccaatacggatgtattatctattctcactatggcgaatcggctactggtggtgagtatgattcaggacaggatgcttataaaaaattctttgaagaattgaaagaagctgcagacgtgctgcgtactgctaaagaaaaggatgtggcttcgtttatgatgtttgattatgcctatggaggtaacttgaacaaatgggcgcagttgtgtaacaccattcgtttgcgtttggccatgcgtattgtgaagtatgatgctgcttgggcaaaaagtgaggcggaagctgccatgaacgatagtaatggattgattgaaaccaatgatgctaatttcggcattgcaggaaacggttatgtcaatccgctttacggtattgcattcaactatggagatggtgttttaggtgctaatattccttctatcttgtctggtatgggcgatgcgcgtcttgataagtatgctacacagaacagcaagagtgaatattttggtattcgtcttggtattaaaggactggaagaagaagggttttcggatgcctataaggcgattgtaagtcgacccaacttgacagaaacctctcctgctattttggcaactgctgccgaaaccattttgttggaagccgaagctgctttgcgtggttgggatgtaaatggtaagggcaccgctcagagcttgtatgaaaagggtatacggacatcgttcgaacaatggggagccgctgtgggcgattatttaagcagtacgactactgctgcagcgtatgtagaccccgttattcccgctgccagcattgaaggccagagcaaggtgactgctaaatgggacgagtctttgagtaacgaggaaaaatttgctaagattgccacacaacgctggattgctatttatcctgaaggtatgaatggctgggctgagatacgtcgcactggttatcccaaattattcccggtaatggtgaactacagtcaaggtgagattgatacagatcttggcccacgccgtttacccttcaccatcaatgaaaaaggcaataatcctaccggttatgccaaagccgtcgaaatgttgggcggaccggacaatggcggtactcgcatcttctgggatgtagataaaccgaacttctaatccgcattattatcatagagattaagtgatgaggactttttgaagcatgtttttttaaggggaagtatgaaatctgtttttcatacttctccttatgttatattgatatagggtcaccgtacccaaattcttttatgtatccgctacgaagtgagtacaatgatattttaataatttgttgtaatttatcgatgttttgtactcgctttgcagcttcttgattatcagtgttattataatgcgctgcattcagtatacgactgaactgacttggtttagaataattaactaataacctgcgcttttacattagggtttgaaccttctcgtcggttcttactataaaggggaattcttaacttagcacaatcaggctactgaaccccatttttcaatagcctgatttaatcttaaaaaatatattatgaagaaactcattaaacctctctgcttgttgaccggtctgctttgtgccccggctgttttgcttcatgcccaagtagatgaaaagttgaaagccgacatcgtcagcacgggctacgtgcacagtccgttgccgctcgacgagacaaaggctttcgagacattcggcttgaaaaagaaagtgttggaaactgtgatgctgtgtgatatggaggatttctccaaatggtcgcacaagggcatcggtaagattggtttgactgacgaacggagcaagtccggcaagtacagcctgcgcctggaagcgcccgcccatccggaaaagattctcggctgggggttgggacgcggtacttgcatggcctcttatgatataggaggtgtgaactgggaaggttacaaccgcctgaagttctatatctatcccacgtgcgaaggagcacgcagcatctacctcaacctttatgtggagaatgacggagaaataaaagtacccgacatttacggtcgggaaggctaccacgaaatcaatctgaaaaataaccaatggaacgaatgcttcgtcgagatgtctggactggcgcgcgacaaggtaaccaagatttcatttgccatcgaagtgttcggcaaagaacgtactatgggcgacttccttcgcttcgatgtagatgccgtggaacttcagaaggtggagaacccggaaaccgtaaaaggctggatgcctgcacagaaccgcattatcttctctactaccggttatagtatagagagccccaaaagcgccattgtcaatgtggaaaagcacggcggacagttccagttgaaggatgccgcgacgcaggccatcgtttataccggtcctgttcgtaaggaaaagaccggcctgggagagttcgagacgatagacttctcggacttcaagacacaaggccgttacgtcattcaggtaggggatgtcaccaccttgcctttctatatccatcaggatgtgtgggaggattctgcctggcgtatggtgaacttcctgttctgcgagcgttgcggttatcccgttcccggaaagcacggggcttgtcataatgacttgcatgccacttacaacggacatattattcctataaacggaggatggcacgatgctgccgacatgtcccaacagaccttacagacgggagaaatagcctattccttgctcttgatggccgaacgcgccaaagaaaaaggcaatgtcgacttgtacaaccgcctgatggaagaggctttgtggggaatggactatgtgatgaagacccggctgggcgatggttaccgtgcacagacatggggtaccaatctatggactgacggtgaggtaggcaccgacgacgatgccggccgccgtgaactgcttgtccataacggagctttggaaaacttcctgcttgcaggaattgaagcgtatgcctccatgatggttgagaaggatgaagccctcaggagcaatctgaaaaagattgcaaaggaagacttcggttatgccatgaaacgctttaatgagttgggctttgccgaactgataaagaagggtgggggacatgccgccatggcatccgaaagccagtatcacgccaatatttcatgggcagccagcatgctctacaagctgaccggcgaacagcagtatgccgatgaggccgtgaaggctatccgctacaccttgcagtgccagcgcaccgaaccgctgaaagacaaagacaagacctgcggcttcttctaccgtgatttggccaggaagtccattgtacactatacccaccagtcccgcgactatgcctatatggaagcccttgccgccctttgcgagacacagtccggccatgccgagtatgagcagtggattcgtgccatgaaactctatggcggttatctgaagaatatcatgaagtatgtatatccttatggaatggtgcccagtggcatctatcacaaagatgaagtgaaggattccgccaacttctacgccgttcaggtagggattcgcagcggtgccgataaggatttcgaggaacagctcgaaaacggtatccgtctggataaagagcattatttgcgcatattccccgtctggttctcgtttaagggaaatattgccgtacatttgtctaccggtaaagctgccgctatctgtgccagggtactgaaggacaaggaactgaaagacattgcagaacagcagctcttctgggttgtaggcaggaatcctttcggacagtccatgatttatggggagggcagcaactatccgcagctctatacggcactgcccggagaaacggtaggagagatacccgtaggtatgcagtcttatttcaatgaagatgctccctactggccgcagttcaatacggctacttataaggaagtctggggctcttcggctgccagatggctgatgttggtttccgaattctaaagcaagatgatatgagtgacaagactgtttattcacggcgcaatccggccattgacatgctgagggcgttgaccatgttcaccatgattttcgtcaatgacttctggaaagtgcatgacgtaccccattggctggaacatgccgtctatggtgaggattttatgggactggcggatattgtattcccctgctttttgtttgcagtgggaatgtccataccttacgccattgagcgcagatatgccaagggcttctcggcagagtccaccttggggcatatcctttcccgcacctttgccttgctggtgatgggggcgtttataacgaactcggagttccggctttcaccggaagctccctatccgataggagtatactggttcctgatggccataggctttatcggtgtgtggaaccaatatccgaaaccggcttccggcactcagaagaaccttttccgtgcttttaaaataatcggagtattggttctcctttaccttgccttcacgttccgcaatccgcagggaggtgtattcggtgcctattggggaatattgggctccatcggctggacctatctggtatgtgccgtaatctatatcttcagccgtgaccggttgcagtatctgctgcctgcctggggtgcctttatcctgatatgcctgctgggtacgcctttgcgcgagggctttggcggtgaggctatccttgcctttcccgaacgcaacttctatcagggcatgttgtccatcctgcatatcggcaacggggctttgcccgcatttacaatgggaggtgtcatcctttccattctcagcgcccgctatgccggcaagggtgacggctggaaactccgcaatgggctgacggttgccgttctgcttctgctggtcggaattgggacacaccatttctggattgtggccaagatgggtggcactcctccctgggtgttctatgtgactgccatttccgtggggctctacacactgctcagctatctggtcagccatcaggtcacaggttggttcaacctgatacgccctgccggaacggctacgctgaccacttatctggtgccttatgtcttctatggctttgctgatgtgaccggtgttgtcctgccggactggttcacacatggattcatggggctggtcaactgcctttgttttgcctttgtggtaatcggcgttacctgggtgatggaaaaactgcatgttaaacttaaaatttagatagaatgaaaaagagctttttacctgcattcttgctgctgttccttgcgctgggcatgttctcgtgccagcagggagctaagaaaacaaccaaggaatatcccatgttctggacgtggctggactatcgtcccggcatgaacttcgactccatctgccaagtgatgaacgacatcggcatggatggaattatgctgaatgcgccgactcccgacgattaccgggctgccataccggttgcccataaacacggaatcgaagtgtatgcctggttatggaccatgaatctggaacacgaccgtgacaagatattgaaggagcatcccgaatggttcagcgtgaatcgtaacggcaagagcctggcagacactaccgcctatgtaggctattacaagtttctctgcccggcattgcccgaagtccgcgagttcatcaaggaaaaaatcaaggcctactgcgaagtggaaggcttgaatggcattgccatcgactatcatcgttttgtggatgtggtgcttcccaccaccttgtggccccattatggcattgtgcaggaccgtgaatacgctgcgtgggattacggttaccatccggaaatgctcaggttgttcaaggagcagtacggttatgacccccgcgagcaggaagacccttccctcgatgtgaagtggcgccagttccgttgcgaccagataaccgaagtggccaatatgattgccgaagtggtgcactcctacggcaagacaatggctgcctccccgttccccaccccgaagatggcttcacgcatggtgcgccaggactggggcaaatggaatctcgacatcgtgttcccgatggtttaccataccttctatacgggcgatgccagcttcatttccgactgtacggttgagaatgtacgcgacaagaacgatatgactacactgtactgcggcatgaccgccaccgacggcccgatgatgttcgaatgcatggatgccgctctcaacaacggcgcccagggaattgccgtatttaccattcatggactgcgttctccggaggtgaagaggcagttcaaggcttatacggacagtgtcagagccgtgcgtgccgccaatggcggggtgataaaggctacccatcccgaagtggcggatcccgaccccttcaagcatgaaggcattatgaagctgatgcaggaacgcatgcagcaaatcatagccaaggctgccggcaaggaagagccggctccgctggcattgggcgagtacaaggaggtggattcctatgacgcgacacgctgctaccaagtggtggatgagaatagcaagactacttttgacgtgacattctatctttacggcgacgttgtttccggttgggatgtagcagtagcagacaaggcttctactaataagaaatgaaaggacgttttatgatagtgagagattacgggagcaaactccttctgctcttggtgttttcaatggtaggcatggtttgttgcaatgcccagagtggaaagagcttgtccgtaaagaaagtaatgtgtacggcttcaccggaaggtgaggctgtgccgtccttgctggacgagaacgggatagagtttcagccccttgatgtggtcaactggaaagattatccctacaagccggaagtgagtttccgcatagcccatacggggcgcgaaatcctgctccactacaaagtgaaggaagccagtgtgcgtgcagtggcctccggagacaatggccgggtatgggaagatgcttgtgtggaattcttcgtatctcccgaaggtgacgaccgctattacaatttcgaatgtaactgcgccggcaggctgctgattcagggaggtgcagtcaatgagcgccgtcctacggcgagtcaggaggtgctgggcatggtgaaacgttggagctcgttggccggcgaacctttcgaggaacgtttgggcgagtgcagctgggaactggccatggttattcccgtttccgctttcttccagcattccgtcggttctctggacggaaaaacaatgaaagggaatttctacaagtgtggtgacaaactccagactccccacttcctttcttggagtcctatcgggctggaacgccccatgttccactgtccggcctttttcggcaccttgtcttttgaataaatctttagggtgttctggtggaatcatttgccgttagcattacttattggattgacaattgcggaattatgtgtttttttatacctttgcacttcctaaattgtaaatgcatatatgattaccgcagaacaactgaaagatatcaaagaacgtaccgaggcgttgaaccgctatctggacattgaaggaaagaagatacaggtggaagaagagcagctccgcacccaggctcccggtttctgggacgaccagaaggctgccgaggctcagatgaagaaagtgaaaggcttgcagcaatggatttccggctacaatgaggtaaagaccttgactgacgaggtacaactggctttcgacttttacaaagacgaactggtgactgaagaggaagtggacgatgcctatgccaaggcaatcactgctgtcgaggccctcgaactcaagaatatgcttcgcgaggaagccgatcagatggactgtgtgctgaaaattaactctggtgccggtggtacggagagccaggactgggcaagcatgctgatgcgtatgtatctgcgctatgccgagactcacggctataaggccaccatcgccaacctgcaggaaggagacgaggcaggtatcaagacttgtaccatcgagatttccggcgattatgcctacggctacctgaaaggtgagaacggtgtacaccgcttggtgcgtgtttcgccctacaatgcccagggcaagcgtatgacttcttttgcatccgtgtttgtcactcccttggtagatgataccatcgaggtgaacatcgaacctgcccgcatgtcatgggataccttccgaagtggtggcgccggtggacagaacgtcaataaggtagagtccggtgtccgtctgcgctatcagtataaggatccatatacgggcgaagaggaagaaatcctgattgaaaataccgagacacgagaccagcccaagaaccgcgagaacgctctccgccttctccgttccatgctttacgacaaggaactccaacaccgcatggccgagcaggcaaaggtggaagccggtaagaagaaaatcgaatggggtagccagattcgtagctacgtcttcgacgaccgccgcgtgaaggaccaccgtaccaacttccagaccagtgatgtgaatggtgtgatggatggaaagatagacggctttatcaaagcttacctgatggagtttgcaggaagtggcgaataaattttctccctttcatttgcattcttcccgaatttcttcttactttgttcatcgttgaactttaaactataaaacacaccatgggaaaaagtaaaaagaaagcaatgcacagccagaaggaagagcaacaagccaagaaagtgatgatgacgatgggagtaatagccattgtattggtcatcgccatgtttgtggcttactcttactggggctgataaaatcactggaaacgacatgccgcaggagatagaacggaaattcctcgtgacgggagaatacaagccacaagcgtatgcacacagccgtatcgtacaaggatacatcagcagtgtacgtggacggacagtacgggtgcgcatccgcgatgaacggggatttctcaccatcaagggtgcatccaatgaatcgggaaccagccgctacgagtgggaaaaggaaattccgctgtgcgaagcgcgggaattgctgaagctgtgcgaaccgggtatcatcgacaagacccgttacctggtgcgcagcggacagcacgtctttgaggtggatgaattctatggcgagaacgaagggctgactgtggccgaggtggaactctcctcggaagacgagcctttcgtgaaacctgcattcatcggacgggaggtgacgggagatgtccgctactataactcgcaactgatgaaacaccctttcaccacgtggtagcaaaccaattgtatgccgtacttgtttaatcgtcatggagaaactttacgactacctgccaagagaactggtcaccttccttttggtcaccgtattctctttactcatcgggctttcacagcgtaaaatcagcttgaagcgcgaaggggaaactacgcttttcggtaccgaccgcaccttcacctttataggcattctgggctatctgctctacatcctcgaccctacggactatcgtctgttcatgggaggaggagccattctggggttgttgctcggactgaactattatgtaaagcagtcacagtaccatgtgttcggagtgactaccatcatcatcgcgctcatcacttactgcatagctcccattgtggccacgcaaccatcgtggttctacgtcatggtcatagtgaccgtcctgctcttcaccgagctgaaacacaccttcacggaactggcccagcgcatgaagaacgacgagatgattacgcttgccaagttccttgccatcagcggcattatcctgccgatgctgcccaatgagaatcttattcccggcatcaacctgacgccatacagtatttggctggccacggtggttgtatcgggcatttcctacctttcttatctgttgaagcgctacgtcttccatgagtcgggcattctggtttcgggcatcgtgggaggcttgtacagcagcacggctaccatttccgtactggcgcgaaagagccgtaaggcttctgtgcaggatgctcccgaatatgtggcggccatgttgttggcagtcagcatgacgttcctccgtttcttgatattgataggtattttcagccgggagacgctactggccatttatccctacctgctgataatgtcggtggtaacggctaccgtggcatggtatctgcattccaagcggaaacgggtggacgacggcacgcagaccacggaggatgaggacagcagtaacccgttggagttcaaggtagcgctgatttttgccatgctgtttgtggtgttcactatcttgacccactatacgttggtgtatgccggcacgggcggactgaacctgctctctttcatttcggggttcagtgacattactcctttcatcctgaacctgcttcaaggaacgggcagtgtggcggtgctggtgattacggcttgcagcatgcaggctattgtcagtaatatagtggtaaacatgtgttacgcgttattctttgccggcagaaaaagtcccttgcgtccgtggatattagggggattcgtttgcgtgattgcaataaatgtctgtctgttacttttcttctattttctctaaatttctacctttttgcttttttaactccgaaagtctcgtaaatgtgtgaaaagggactacttttgccaaattcattgtgacaaaactcaaacggaaaacgtctaatacgaagacaataaacaagaatagtcactaaatataaaaacgtaatgagaataaaatggactgtgctgctatggatgctgatgatttcgggactgcttgcagcgcaaaacacggcaaacacttctttccaggttaaaggaattttgctcgactcgctcacccgggagggtgaaccttatgctaccattaaaatcgtgaagaaagaggcccctgcaaaggcgctgaagatgctggtaacggacatgaaaggccagttccaggagagagtacccggtacgggcaacttcgtgatgaccatcacttccgtgggacgtactcccatcgtgaaggacttttctgtgaaggcaggggagaagctggtggacttcggcacgctgtatatcgtagatgcctccaatgagctggggcaggtggaagtagtggcacagaagcctctggtgaaggcagatatcgacaagatagagtacaatgtgcaggacgaccctgacgcccagtcgaactccgtgctggaaatgcttcgtaaggtaccgttggtaacggtggatggcgaggacaatattcaggtgaacgggagcagcagcttcaaggtatacgtcaacggaaagcccaataacatgatgagcaacaatccgacggaagtgctgaagagtatgcctgcaaacagtatcaagcatattgaagtgataaccaatcccggccccaagtatgacgccgaaggtgtgggcggtattctgaacatcgtcaccgtgggcagcggactcgaaggctatacggctacgttcagtgccaatgtcagcaaccgcggtgcaggcggcggggcattcggtaccataaagagcggaaagctgaccgtcagcggccgctacaattacaattacaacgaccagccccgcaactacagcagcggcagccagcacgtgacaccggaagctgttacggagaattcttccaatctggactatgacggcagcaacaagggacacggttctttccagtcgggcagcatggaggccagctacgaaatagatacattacgcctggtcaccatgtctttcggactttggggcggcggtaacaagagcaacggctctacagactacatcgccactttcccggagagcatgaacgctgctcctatttacagctattctgccttcaaccgcagcaagtcttcctggtattccatcgacggaggtgtagactaccagcgtctattcaaggtgaaagaccgcatgctgacgttttcctacaagataaacacccgtccgcaaacgtcggattcctatacggaatatgaaatagacaatggctataaccccgattgggcagactatctgaaccgcttgaagaacctgcataacgacggtgagcagaatactacggagcatacgttccaggccgactataccacgcctatcggcaaactgcatacactggaggcaggcaccaagtacattctgcgcaacaactcctccgaagacgaccgttttgatgcggacgataccggaaagtatgaatacaacaaggaccagagctcgcactacaagcatttgaacgatatcatcgccgcctatctgggatatggactgaaggtgaagagactttcgggccgtttgggattgcgctacgagcataccatccaagatgtgaagtatctggtgggccgcggcgaggatttcacaaagaactttgacgacgtagtgccttccgcttctatcggctacaagctgacggatatgtccaatctgcgtttgggatacaacatgcgtatctatcgtccgggaatttggtctctgaatccttatctgaatgatacggacccctcctacatcagccagggtaatccggaactggacagtgagaagagccatgctttcaacttgagttacagtaacttcacacagaagttcaacatcaatatctcggcccgctattcgtttaccaacaacagtattgagaatgtgacaaggctcatgcccgatacggagattgagggattgaagaaccccacgggcaaggatgtgctttattctacctatgccaacatcggcaagacccgctatgctagtgtgaacggctacatcaactggaatgccactccacgtacacgtatctacatgaacatgagcggcaattactcttatctggaaggcagtgaaggcatgcgtaacgatggctggagcctctttgcctacggcggtgcacagcagacgctgccccatgactggcgcattagtctgaatgtcttcggacagacgccatggattatgctgcaaggtaagggcagcagcttctttgattatggcttgagcgtcaacaagtccttcctggacaagcgcctcaccttgtctgcctttgccagcaacttcttcaagaagtatatggaccaaagctccaccaccgaaggcagtggctttatacgcgaaagcaactataagtacagccgtcaacgtttcggcataagcgtcagctaccgtatcggtgagctgaaggcaagcgtgaaaaaggctgcgcgcactatcagcaatgatgatgtgaagagcggaggcagcggttccggtggcggcggtgaataagttgtaaatacatttatggatatgtcaggcaggtgactgttccgtccattgtcattacgatgaggcggtggtcacctacatttttcagtgaggtgactgccgaatgggacaccttatggctccaggctatcccgcttccgtctgtccgcacggcatggaccaccccgaactcggtggggatgaacacatattcctccgtggtttccatgcgggtggggatgaaattgctctcatacggcatcagtgtgtcccaaagcggagtatagcttccttttgaaatgtctgctgccgtgatattgtttctgataccttttacgtacatggtctttccatccggggagaagccgagggattcgcgtcctttcgcttcgtccgatgcccagaggattttcccgtcttcggggttgaaggcgcgtacgaagtagtcggaactgagtacgatgacctgctccgatgacttcccgtccttccggtagggcagcactaccggccagcaggctcccggagagaagtatcttccgcgtccggtgtcgaatttccataccttttctccggttttccggtcgatggcatagaacatggctccccaggtcccgatgtaagcgcgtctgctgtctatggcagggcgggactcgatgtagccgtccagtccgtcggcaatccagtcgggtgtgccgtcggccaggtggagggagtagaatttcccgttgctgctgcccacatagacattgccgccggccactgtcgggcaggctacaatggggtagcccgtgtcatatctccagcggacggagccatcctttttgtccagtgcatagacaaacccgtcgcaggaagtgacaaccaccagccgggaagtgatgaagggaaccgagaataccttgtttccggtggcataagtccataccgtttctccgttgcgggcattcagggcgtgtaccattcctgccgtattggtatagatatacagttctccgtcaatgcttccttgcgaggcaacgtcggttacgtctttctgctgccacactttacggacggcgggataagtgctgttgatgctgaaatccgggtggaagtaaacggtatctttcttttcacccggaatgcccggtgaggcgacggtcgccgcatgcaggcgtacaacattccatgcggggcgggtttccgttttgatgatgcgctcgcagaaggtgatggaatctttgccgactgtgacgaggttgtagccgcctatcgggtctttcctccgcagggaggagcgtccgatgaccgccggaatgccctcggcatcataggcgcggttgacgtgcagatgtccggcaagcgccaccagtacgttgcgtgttttgaggatgtccgtcacttcgtaccagttgctcaggtcttggttcagcgggaagtggttgacgaagataatcggttgctcccggggtgtggcgcgtataatggagtccagccagagtatttcctcgcgcgggatgtgcggaggtcccatacgcaggctcggaccggcgccacagccgatgaagcgtactccctgccagtcgtagcagaaatgggatgctttgaaaatcttgttgaacatggtacagccgttttcactccagttcacgtcgtggttgcccggtagcagcagataaggtttccggaagtttttcagaatctcctgcagcagcaggaactctttggtgtctccgaactccgtgacgtctccgcttagaatcgcgaagtccacggcaggattggtattgatgtcctcgatggattgccggaggtcgtcttcggcataagcgaaggaattgaggtgtacatcgctgagccaggcgaaagtgaatggggtccggctgctctgtccgtaggatgatactacggacactgccatcacgcagatggccaataagatacgtttcatgatgatgattggtttgagtttgtccaaagatagggataattttacaatcatcaatagttatagaacggaaaaagccctcaacaagcgttggcagcttctgagggctttcgtgtggggtattatttatttaccggttgagaatcccagtttctccagtcccttccgtacatccggatggctcatgaacagcttccacagcagcccggtgcggtaattctcgatcatcacggctatcggtccctggtctatggcgaggtagcgctgcggataccagttgtccgtttcgctgaaggcatcgtagaagccatagggaccgaatactttgtctcccatttcatagagatgccgcattacctgcagcgactgttccggggtatagacgatggatgacaaggcggcggtgggggagatgactccctggtcgtcgcgctcgttgggggcatgggcggcatatccgttgacggagtagctggcggtcagcccccagcagtcgggcccgaatcctttgtaatgtttggggtttcgtatgcagtatgctcggttcacaagtgtgagattgcgcatctcatggaagtagtcggtacagtattcatccttcagcccggtagggtcgaggccgaggaatgagtattgtgcccagaagagcggtccggcttccgtgccttgatatcgcagatgcagctcgatgccttccaccttatggggctctacaatggctccgtcctgtgcccatccttcgtgatagacggcggcaggcacgccgtgggtaggcgaggcggcggcaaggatatacatgatgaggcattcgttgtatccgtgtacggggaagtccatctcccagccgtattccgggctccagtgccagtagagtacattccggccgttgcggcgatagaagtcccagtccacctcgcgccagagcttgtcgatgcgggtggcgagggctttctcttgttcattcccgtttatgtagtattggtggacggagagcagtgcctgcatgatgaaggctgtttctaccagatctccgccattgtctttccggccgaagggtttcaccttgcccgtatcgccataccaccagtgtggataggcaccgtgaaagcggtcggcggtttcgaggaaggaaacgattctctccattcgttgcaggccttcttcgggggtgacatagccgcggtctatccctgccagtatggtcatgatgccgaagccgcttcctccggaagtaaccacgttccggtcgttctccggataaacgccgtccatgtggatgcgctcccgtgccagtccgctgttgggctccgcgccttcccagaagtagttgaaggtccggcgctgcacggtgtccatcagggcgtcatcgcttggcagggcttcttgggtgccggggcttttgcattgggtgaatcccaacaacaggcataacaataaaaagcaatatttaaggggcatatctatattcattaaagggttaaatcgacgagtacaggacaatgatcggaaaggaaaccattctctggcgtatcctggatgacacggtagcgatcaactttcgcaccgtcggtaacgaatacatagtccagcaatacgcgttcgtccaagggaatacggccgaagtcatggaaagaccatgatggaccataagttatgccggccgttttggatgtattctgcattccgcttttttccagtatttgcaggggttcctcgtctggctcacagttgaaatcacctgtaatgatggctggcatatcaggagctatctgtttgattttgttcaagaggagtcgtacaccttccttgcgggctaccttgccgtcattgtccaggtgagtgttgaaatacacaaatttctttccgttgcttttttcttgcaatactgcccaggtggtgacacggttataggaagcgtcccaaccttttattccgatggtgtcgggatactcgctcagagagaagttcccatattctacaagtgtaaagcggtctgtcttgaagaataccggacaatattcaccggcttcttttccgtcatcacgtcccacaccgagtgcggtgtattggggaagcccctgtttgagatcttccatctggttatggcatacttcctgcattcccagtaagtcgggttggtagtaggcaatcatcttgcaggcattgtctttccggtatttccagttgttggcactgtccgaaggagcatccaggcggatgttgaaagtcatcacttccagtggctgttcgttctgtacaggctgtttcttacaactgccaaggagcagaatgctgcaggcacaaagaaaaaaagttgtgtatttcatgttttctaaatatttattaagtactatttcagtgtcaggcgtgcagatcttacattccggctgtctccacctatcatcacgtcaaagtctcccggctcggctacttgtttgagatcgtagtcgtagaagcgcagcagttccggcgtgattttgaaagtaactgtcttgctttcacctgccttgaggaatattttctcaaatcctttcagctctttcaccgggcgggtgatgcttcccaccaagtcacgtatgtagagctgcaccacttcagcaccgtcgcgcttgccggcattggtaacggtaactgcggcggtaatggaaccgtcctgtcccatagcagatgcactcagggcgatgtcgctgtactggaaagtagtgtacgagaggccgtaaccaaaggggtacaacggctcattgtccacatccaggtagctgctgcggaacttctcgaaccatttgccttcctgcaggggacgaccggtattcttgtggttgtagaacaaaggtatctgccctacattcttggggaatgtcatcgtcagcttgccgcttgggttcacatctccgaagagcacgtcccctatggcataagcggcttcgcttcctccgaaccatacgttcagtatggcaggcacgttctcttgttcccaagtcagtgttaacggccgtccagtgaacagagtcagtactaccggttttcctgttttcagtagtgcttccaacaaggtatgctgcacgtcgggtatgttcaggtctgtgcggcttgagctttccccgctcatctctgaagattctccgagggctgctacgataatatccgcatctgctgccaccttcaacgcttcttcgagcagttccttatccgtacggttgtccctgtttagtgaccttccgaacatggtcgcacgttcttcgtatgcggcatctccgatcaagttgcttcctttggcgtaggtgatgttgacctttcctgccatcatctccttcagcccttcatatagggaaggataatcgttgagccttgccgccacactccatgttcccggcatgttgcttctcgtatttgccaagggaccgatgactgctaccgttccctttttctgcaggggcagcaggggagcctgtccggtttttgccggttcattctttaggagtacgaaactttcacttgcaatcttgcgtgcgacgtcacggtgctctttagtgaagatatcgcgtgccggtctgctcaggtcacaatatttataggaattgtcaaacagcccgagcttgtattttgcttcaaggatacgacggcaggctgtatccagcgttttcatggttatcttgccttcggtgagcgattttttcagggtgcccacgaaaccttcgcttaccatatccatatcgacgccagcgttaagggcacgggcagaaacggtttgcaagtcaccgatgccgtgtgccaccatctctgcaattccggtaaagtcggtcaccacgaatccattgaatccccattgcttgcgcagtacgtcagtcataagccatttgttggcggtggcgggtacgccgtccacttcgttgaaggaggccattacgctgcctacacctgcgtcgacagccgcttggtaaggatatagatactcgttgaacatgcggttgcggctcatatccacggtgttgtagtcgcgtcctgcttctccggctccatagagtgcgaagtgcttgacacaggccatgatttcatcattccgtttcagttggtcattcagcttgtctccctgatatcctaacaccattgccttggcaatggcacctcccaggaaagggtcttctccgttaccttcgctgacacgtccccaacgcggatcccggctgatgtccaccatcgggctgaatgtccaggatataccgtctgcacttgcctcgactgctgcaatgcgtgccgacttctgaatggctttcatatcccatgtgcaggataaccctaacggaatggggaatatggtttcgtagccatgtatcacgtccataccgaacagcagcgggatgcccagtcgtgagttctctactgcgagtttctgtacgtcgcgtatctttgccactcctttcagattgaaaagtcctcctacaagtccttgttcaatcttcttggccacgtcgctgctctttgcttggccagtagtgatttctccggtgactggcaggttcagctgcccgattttttcctccacggtcattttcttcatcagtgcgtcgatgaatcgatccatgtcctgcggagatttttgtgcctgtatactggtgctccccattaggatggcagccagcaatagacttgttcttctgaaaactttcttcatgatatgttttgttagggtatttattaagtttcgcaagttaatggtaatcccgtacataagtatgttactatcattaacctgcgaaagcttaatttgttcataggattttactcatccttcggttctttcagtaaatcaggaatttgagtgtattgattgaaaggcaatggcaagagagctttgtcttcagaccaacctttcaattctgtttttgccaggcctgtacgtacaaggtcgttatatcgttcaccccattcacagactaattccatgcggcgctcatctataacttgttcaaaagttacatttgtcagttcaggcatttgggcgcgtcttcttacttcgttgaatggtgcatcaccgcttttcccgttcttgattttagcttcggcattcatcaagagaacatcggcatagcggaaaatacggacattgttgtttgtaccgtatttcgtacggccgggagtcagctgatttagtggagtgtaggctttgccattccaacagtctgtattcgtcgggttcgtttgcggcttgatatagtcaccgtcgggggttgttgagtctgccatcaggaacgaagttgtggcacgtattgtttctccgcggttatacgcccagtcacggaaagacttcaagataccgcagtctccccaaccgttgatgttgctaccggaatttttaggaccttggcaggtaaaccattctcccggatcaattaaatcgccggagccattaccaaagtcagtcatttgactttcgaatatggactcgtcacagagttttcccggaattttgaataattggtagaaatccgggtagagtgaaaagtttccatgctcgatgatatcgtctgtgagttcttccactttagcatagtcgcccatattcaaatggattttggcagctaacatttcagcggagaaagctgtgacggctcctttatgctcattttgattgggacggatgcggggcatattgtcaataccgtactgtaaatcttccaatgcatatttgtttactgcattggcagtagaacggctcaaatcagtctggttgttgtcgcgaagaatagtaaccgctccaaatgcttgaaccagacggtaataagcataagcacgcataaacataacctcaccgcgatatgctttataattcttcatatcgttgtcgttggtgatattctcggcgtataggtccaatgattcgatggctgcattggcggttttgatgatattgtagtattgcatccacaattcattgataccccagaatgaatcattgtacttatattcactcaaattataatagtcactgccattccattggccactgaatacatcttgatcacggatggtggtaatctcccaaatcacccagtgcaaaccactggtccgtattttggcatatacacccgatacaggctgatacatattgctgatatcggtgtaatctactttttcttcaggaactttgccttcgggctctttgtccagaaaatcattgcaggatgcgaacgacaatgccatcaaggcggacactatatatataaaaggtcttattaatgctttcattagttctaaattattaatgggttatttcttagaaatcaattttcaagcctaatgtgtaagttgatgtcagaggatatacttctgtatcccaaccttggctgtcagacaattcagggctgaaagcattggctttaaaggttgtgaagggacgatcggctgtcaagctcaggcgtaagcccggcatggtatagttaccgaacttgacattacggaatgtataacccagcgtaatgttttgaatgcggaaatagtcggcgctctctacaaagtaagagctatatttctggtcgcttacgttccaaggtttcagcagggcagctgccgacgggttagagttggtagagcccggtcctgtccaacggttctcgtattgagcccggtcgaagttgtagttctgggaagaataacggagtgcacgtttgcgattgaacatctgggcaccggcttggccgtaagtcgtcaattggaagtcaagattcttgtaattaagaccgaggttgataccgtaagtgaagttaggaatataagagcctaatgtcgtacggtcatttccgtcgagaacattgtttccatcaaggtcggcatatttcaagtcacccggtacgcagccgttggctactgcaatcggatcagcggcgatttcttcttctgtctgatagacgccgatcattttgaaaccatagaatgaattcatttccttgccaacaatgttgacggtcttgccacctctgatgatactgttgccattcaaatctttcacacggtttcttaaagtagagatattcacaccaatgttgtaagaaaagtcttttcctattctgtcattccagtcgacgctgacatcaataccggagttgagaattttaccgtagttaccggcaagggtcgtagtactgaaaggaagcagcggagcaatcacagcattattcgtcatgcggtgatagtaatctacgtcaatgttcaagcggttgttgagagtgatgaagttgatgccggcattccactcttcaacgacttcccatttcagccaactgaaataggtattgttttgataaccggggattgtggcattgccaaatacaccggatgcactgttaccggtagaaatagaagcaaaaccatcgcttgcagctacttggtcattacccagtttgccccagcttgcacgcagtttcaggaagtcaatccatttttggtccttcaggaatgattcttctgacaaaacccaggcggcacctacagaggggaaataaccccagtgttcctgatatttgctggaaccatcggcacgcatggtaagcatcaacagatatttgtcggcgtagttatagttcagacgtgcgaagtaagaaatacccctgtaacaatagccgtcatcttttacggtggcacctgcagcatcgccgttcttgatgtaccagtattcgtccgctccatcaggaacattgcttgccttgccctcaaacatacgccattgttcttggcgcatggagtagcctgccatggcaccgaatctgtgtttgccccattggtcattataagtaagagtgttgtcccaaatataattgtaatatttgttctcgttttttgtaagctgtgtggtggctgattgctgccagctgcttacataatgtttcggagtaaattcgcgaccctgagtggagaggaaactataagaatagttggtcttgaagttcagcttgctgggaataaagtcgatctgtgcatagaaattgctcaatacctgataattttccttgcttgagtcgaaatatttggcagtggcaacaggattatagaagtttgaactatagccaattgcatctggagaaccgaatttgtcggggaatccctgttcgttgttttcgtcgtagagtgctacgataggaggacaattgaaggccttctgccaagcttggttattgggcacttgttgtgtggagttgctgaagacaccgttgaggccgacctttaaccagttggtcgcatcataatcaacagaaccgcggaaattcatacgtttgtagttgttgtcaacatccatgataccatcttggtacagataacttacgccaacagaataaacggccttttcggaaccaccattaatatttaagctgtggtttgtgatggcagcggtgcgcaggaggtagtcataccaatcgttgtctgctccgaatgtccaattgtggaaatccgagtcggcataactgccgccatatttatcgatggactgtttaaaatgtgattgataggcatcatagttcccctcgaggagcatagtcgcatattcatgagcgttacacagctccaatacattagatgctttttgaatacctacatagccatcgtaagaaattttagctttttgattgcgtgagcctttcttggtagtaatgaggactacaccgtttgcggcacgtactccatagattgcggcagccgacgcatctttcaagatagacatttcttgaatgtctgcattgttcaggaagttgatattgtcgtagaacataccgtctacaacgaacaacggtttactgttagagaatgatccgataccacggatttgtacggtaggtccttcgcccggagcgccgttgttcacgatatttacacccggtactttaccttgcagggctgccataggcgtagtagaaggtacagtagtcaatgcttcacctttaaccacggtaatgggtgctgtcaaatccttggctttggctgcaccgtaaccaattacgacaacttcttccaattgctgtgagtcttctttcagtgtgacattgacaatggactgtccgtttacttttacctcttgggtcaacatccctatataacttataatgagtgttgcattttctggtacattgtttagtgtatatttcccgtccaggtcagttacaacaccgttattgctaccttgtacaaggatggatacgccaattagagcgtcacctgcagcatcggttacggtacctgtcactgtttttgtctgggagaatgccggtattgttgccaataacaggcatgccgtcaagaatagactcttgagccagatagctcttttaagaagatgtgctttactcttcattgcattaaatttttttagtggataacttgtttaaattaattcttaagctctgcgcagtgcttgaattcaactttttcgcaaaagtatgtatttcgataaatggaaagtgaaaaaaacattcatcaacaatacatgtccttgaattttaacaaataatgagactactcatttactactcaaattaatgtaatgtgttgtatcttagatagatgttttttggattcatacattttgaagagtcacttttttcttgtgtatgaaaggtgggtgattcctttcatcgcatgactgatgcgccttcttttgtcgaccttaccgtcctctttcttttgccaattgattattaaaaggctttcaatacaatattaaaaggcttctaacactatattagaagccttttaatgccatttcagtcgtatagtcagtccggtttgcctttacaggctttccacttctctatatcatggatatggacttatggtttaggactctcgtttatcttttcaacatggctctttaatagttcgggttctgtaccagtaccccgttggatttgtcgatttcagtttgcggcaatggcaacagggcattcttatcttgataattctttccggcagcttgaagcacctccttggcaatgccccaacgcacgaggtcgtagaaacgatcgggttccagaccaagttctacacggcgttcgtggcggatggcatcccgcagttcgctttggttggtggtggttactttgggcagaacatctgtcaaggtaccacgggcgtgtgcacgtacttgttccagatagtcgagggcttcggtgggcaggcctttttcattggctgcttcagcacccatcagcaatacatccggataacggatgatacggatgtttacccagaaaccgtttttggtatatttcttgcgcagttccggttcggtataggctttcttgttgaagtaggctcccatggcggtggaaaccggagattccccgtaaggcttgttcgtattctctggtgtgatgggatcatccacgcttttgcggaaatagagcagggtggcatctttacgcggatcgcctgtttcaaaggctgtgcccatctgcttggtggccatgtgccagccccaccccaagttccagtcaccggcaccgcgcacgccttgtacttcgcagaactggctgccgatgctgaggtctgccttcatggcatccgtagcctcgcattgcaactcgaatacgctttcaccacagttctcgccttctacggtaaacaccttgtccactggggtattcaggttgtagatgcccgacttgataacgtcggtagcagcatcatacatattatcccagtcgttgcgcatcatgtaagtacgcgcatgcagggagcgtgcggcaccccacgttgcacgtcctgtatagtcggcactccaagtcaggggaagacatttttcggcttcggtcaagtccttgtcaatctgctcgtaaatcttgtcggcagtggttttgggtatattggcgtcagcagcttccactaccttgaaagtaactaaaggaacttccccccaggcacgtaccagattaaagtagcagtaggcgcggaagaacagtgcttcacctttggtccgaatgttctctgtatcttctttgtactcacttttttcaagatcgtccaggatttcgttacactgatagatgattttgtagttctggccccagtaagcacccagtattccgtttgaggctgtgtattcgaaatcatcccacatagcagcgttgtctgcgccgtcgcctgcgtcgctgcccttttcggaatcctcactgcgtaccatgtgaaccatgaatgcagggatgccggctgtgatattgtaactgcgcatcaggtagtaaacgttgtacatctttccgcctaccagggcgttaggagcgtcatcttcggtgaattggcccaatgggtcacggtccaggaagtcattacaagaggttaaggcaagggctgtagcaccagccaggagtgttgataatatatggtttcttagtttcatgttttcaatacttgctatgattaataatagggttagcgggggatcagaatgtcaggttgaagccgaaagtatagatagccggcatcggatagctgccgtcatctacgccaaaggcaatggctgtacctcccagttccggagtgtaaccggtgttatgcttccaggttttcaggttctggatatttacataaagcttcaatgcctgcatgccgattttcgaaattaactttcggtcgaaattgtaggccagagatatattgcggatacggaagaagctgccgtcttcgatgtagtactcggagttcaggttgttgatggtatgcttggtgttcagcaacggttgggtgttgcttgtaccgggaccatgccagcggtccatgcgttgctccatgaaattgaactggctccagttgtagttgtcccaggtacggtaaatctggttgccggcttgtcccatcatatcgatgcccaaatcccagttcttatagcttacgccaagggtaatgccgtagctcacgtcgggggtagggtcaccaatcatggtgcggtcggcggtggtgatttcaccatcaccgtttacatccacgaattttaaatctcccggagtgaccgttgccaaagtattcttcggcgaactgttgatttcttcctgggtctggtaaatgccttccactttgtagccgtaaaagtagccgatagggtatcctgccatggtgtaactctggctcttatctcctgcaatgattgagtagccttcttgtaccaggctcaacaccttatttttgatagttgtcaagttaccgccgatgttatagccccaatcaccgatttggtcgcgccagttaagggcaatttccacacccttattctcgatggagcctaagttgcctatacctggaactgtgcctgagatgcccggaacttcggcaagcaagtttttagtcgttttcttataatacacaccttcaaagtgcaggcggttacggaagaagttggcttctgcaccaacttcccatgcttctaccttctcccaacgcaagttaggattaggcaggtaagaaagttgatagcccggatagatggcagacggagtaccgaatacggcagagtaggcattgctcaacagaggttctgccgggtagggcttgtccagattttggttacccagtgtaccccaggaacctttcaactttaacatatccagccaggtgatgtccttcatgaattcttcctcactcatcagccagccggcacctattgagtaaaaattctgccattggtttcccgtataggaaaaagcggaagaaccgtcacgacggaaagagccgttgaacaggtatctgcctttatagttgtagaggatgcgtcccagcatagataccgtactacgttcccattgtgtactgttgttggtggctgtaccggcatcaccgatgcttacgtaccacttgtcgggattattggggattaccaggcctacgccttgtgtgcgggctgcaccaagcagctccagttcattgtaataggtagtgaagcctgctgtagccgtcagactgtgctcaccccaagtattctggtaagtcagcaagtaatcgctctgcacttttgtttctgtctgtttctcttggcttactccggttttcccgtcaccaagggtttctactttgccttctacactgttgtcaaataccttgatgataggggtatatttgcgggtgctgtttgaactgtagtccatggagtacaccaccttgaattggaaatgtttcaagaagtcccattctccatacacgttgccggatgcacgatagttttcagcctttgttgtgttggcctttaattccacgtctaccatcggattgttcatctgggccttctggaaccccggaagggtggtatacagtccgtattcttcattgaacacatgagctaccggggctgcccgcaaggcagtggcaacgctcttggtgtctgccggtaacatacgtgcaccgttgaactggaagcctaccttgaagttatctgtcactttatagtcattgctgacgttcagcgtaaccttgctgtacttttctttcttgatgttgccttgttcataggcatagccggctccaaggtagaaactgtgcttggctgaagcaccggtaatactgatgttgttgttggtaatgaaacctgtctggaagatttcgtcctgccagttggtattacctgtccaatcggtaaaattaaattccggattgccttcgttcttcaattgttcgttgtataacgtcttgaagccatctgcatctaccatggcaatcttgtccgtgatggctttgaagccgaatgacccgttgatatttacacgcgtctggccttctttggctttcttcgtagtgataatgatgacaccattggcaccgcgtacaccgaagatggcaagtgaggacgggtctttcaggatttccatggactcgatatcctgcgggttcaggaagttaatgttatcattgaacaggccgtcgactacatacaggggcttgtaaccgttgatggagtttgtaccgcgtacacggatttccggttcggcacctgccttaccggagttgattacctgtacacctgccactttaccttgtagggcggatacaggattgactaccggcttattggctatttcatcacctttgatatttgtaatggagcccgtcaggtcacgtttcttggcactaccgtaaccgatgactacagtctctgccagcatttgcgagtcgtctttcatctggacatcaattactgactggctgccaactctgatagcttgtttctgcattcccacataggaaaattccaacgtgttttccggggttacctggatagagtatttaccgtctatattggtaatgacaccatttgaggtaccttgcaccaatactgatgctccgatcaggggctctcccaatgcatcggtaacagtacccgtcacagtctttgtctgagaaaaggctggcatggttgcttgcaacaaacataccgtcaaaaatagatttttcagccacgagatactctttaagataggtttaggttcttttttcattgcataatttatttaagtggataacttacttgaattatgcatggaacaaacaaaaaacaaaaaagatgtcattcaatagttaaaaagaactcatttaaattttgagcaggttgtaggttaagttttttgcgcaaacgataccggttgttttctactgcacgaatggaaaggttcatcaaggatgcgatatccttggtgtccatgttcagtttaaggcaggcacataggcgcaggtcgttgtttgtgagcagtgggtatgcttcttttagtgctttgaagaatgtacggtgcttttgctcgaatttaatcagaaacattttccagtcatcctctgtgtcgaggttgttggcaagcagattgtttatcttttgataaagaggaagcaatgtcttttgtgtattcttagtgcaaatctcatccacaatctctttcaacttcagaatcagttcattcttgcggataatgaatgaggtctgtgtgaacagttcggcattcttttcctcgatttcattctgtagctcctcattcattctgcgcaggtgttcggcttcttgtgctttcatgtgcctgagatgtttggtctgtaaccgctttttcatcagccagaaggcaataaacaagactgtgataatcagtatgatgcaagtaaggtaccaccagatggtacggtaccacggaggaagtatgtcgaagttgatgatggtatcaggagaataattgttcaattcgtctgtggcgcggatgtgtagggtgtagtttccttccggcagacgggcgtatgagatgctgttccgttgttccggtcggctccaggtactatctactttttccaacaggtattctacaaacaagctttgggcaaatgcatcattgacggagaagcctacggtgacagtgttgtctttgtagggtatccggaggtgcttggacaggtcggcatatccacttgcctggtcctgacctgtatgtacgaattccagattgggaggagcgagttgtatgttctggtgtttgctgtgttgggagctgtgaagaataaaaccggcatccagacaaaccaatgaaagagagtcgttaagtatggagatgttctcgaaagcggtaatcagtgacagattatcagtctctaccttatagctctcgttgatgcgggcgatataaccgtcatagaagaaacggtaaatagaggagccggtgatggcccagctctcttcactgttgatggaaacaatacgtttgatattgtttatgttctggaaacactggttcagaagctggttgggttgcagcgtatcactattttcgtcgtaagaatagaagtggttgccacttcccaggaaaatgacacgtccgctcgctttgaagatctgcagatgtatagggagcgtacagtctttttcatgcccgtaataggtatagtagcggaaagcgtccatatcttcatttaaccggcatttgtatatgcctttgctgacagtttctaaccaaatattgcctaaatggtctatctctgcatcataaatgggatcagtgatttgccgcatgacatttacttttccggtttctttgttgacaatgcgcagttcgttgtaggtaacgataatttggattttttttccattgatggtggcttctacaatacggaacacaccggtgttgagacggtagagctgacggatgctgaaatccgggcagatttcaagcaatccattgttgtggccgcaatataaatgtccgttaatcagttgcaaggaccacacctgcccttgcgtaccctcgatgaacttcagtgaagagaatatttcaaaatcgtttgctttctcttccggtgtgtagaaaacgccttgattggtgcctatcagcaagtagccattccataaggtagcggtatatactgcactggagttggcctcattgcttcgataataacttaagccgtctgtatagcggatgtaggcaatcccacggtccatagctacccatatattattccggttgtcctcgtacaaggacaggattgtgttattttgcagggagttggcagccgagaaatgattgaggatatttccttgtacatctatttcatagattccacttaactgggttcccaaatagtaggagtttcgtttggcgcaatagattccgcaattaagctcttggccatgcaactggctggaaagagcattgttccaaggaatgaagttctttttgtcgtaaatgtagatttcgcctgtggaggttccgattaagtatcggtccttaccataaggtagaataacgcgggtggtggttccattcaggaattcactgccttcaattttacttagccggccatctttgagttggtgcagaggaccatgcatctcttgtacccagtattcatttctcactttcaacagtaacaagaatccttctggaatggtgagttgccgcattgtctgatggtcataaacataaatatttctgaaagtttggaaatagactttgcttccgtctatccagatgcgccagaaactttcattgtccaaaaccttgggcgggagtaacttatttaaagaggtgtatttcagtttgccggactggtctctgtcccatcgtcccagttcttcagcgcctccagtgtagattgtatagtgcgattctacagccaaagccctgactatcggagaattgggcattggatagagttcccattccataccgtcggattcaagtaatccgatgtcattcccaaaatacataatgcctttttcatcctgtccaatagaccagtttttattggctgcatggtatttatcacgggcaaaattgatgacataaggcttttgattggcaaaagaatgacatgccaccagcaaggacagacaaaataaaagcaaatgtctttggaggttcatggtatgattggtattgaatcttgaaatctttaattatctgacaaagatacaacctatttttaaatctttcttttataatatcataaaaaaacctctgagaagtgttctcagaggcctttagttgtttgtcttcatcattaatacaaaatacgtgcggatgataggactcgaacctacacgcctcacggcaccagatcctaagtctggcgcggctgccaattacgccacatccgcaggataattctgtttagcggggacaaagataggaagatttttcgttctggcaaattgttttatggataaagtcgtttcataaggtgactttcagcatttttctcgcttcctcgatgatggtgtccaagtcattgttctcatcttctttgctcatatccacctttttgtcggggtcgatgccgaattcaatctgttgcttcttggcatcaaggtgtggactggcggaaaagcgtactccccatccgttgggcagttcggaagagaacggcagacccgatccaccgccggttttgtcaccgaccaaggtgacattggggaagcagcgcatggagttgacgaaatcattggttgcactataagaatggcggttggtcaggacgactactttcttttgccagcggatgctgttggaaggttccacataaatgggagtcggggttgagaaatcattgtgccctttgccggtcttgtgctggatatatcctgtcagtactttctcgtttgtgaaccgttgggccattagggtggcatttgtcaggttgccgccgccattgttgcgcacatcaataatcaggccgttgcaggcggaaagatacagtaggatttcatccaaattgccattcccgataccactggagaaatcgccataatagatgtaacctatgttatcctctaaaatggtatatttggcacctccggcaatgcggtagtctcttcctaagtacttctctatgatactttcgttgaagttacggggatagtccagataccagtcccagtagcgcgccatgttggaagaagagtacaggttgacgtgtccgtctttcagctcggcaagcatgttgcccaatatttcgaacaaaccgtcatagctcattcccggggtaatgagcggctggtacttgtcatggatagcatcccagtctatttgcttgtagttcaggaagcaatactgttcgtcaataatcttccataaggcttcaaagttaccttggggggtattgtcgaactcttcctcacgaatacatccgttcagcaggggcagtagtgtgagcaggatactcctaattattaaaagatatcttcttttcatgcacattgtctttatcatcttatcgtttatcacctcgtcactttttactttctcttgttaggaaacagatagagctcctttacaaaacccaccatgaacacatgcgagtaagtatgcgtctttatctcgtttactttagactgttgcgcatcccatatataggcaaggcgcatccgggcgcgtcctaccgggaaatcggctgtcagcatttgtctcagagagggctggttgtgcagggaggtgaagttcactactccgtcccagtgtcccagcgtgaatatttcgtaataggactgtccatagttcggcatgaacatgatgcctgccaaaggaaggttcacctggtaacgtagagtgatgggacggttcttgatgcgcagctcccaaatagccattccagatgctgcaagattgatgtaggcacgtgcttgggcggggttgttaccgttgcgcaggttgtagacaaagccgccgttgaagtctcccactcctccggcaagcagcttgaaattgctcgtgattgggaaattataatgcaggccgtagttccaatttgccagtccggagaatgtgttgttgttgtccactttgttgtgcgtatatcccaagtctgcctggaagaaagtttgcagggacacgttgcctcccatcagccgcgtcatccgcatgctttcacgggagatacggaaatcgatacccttgtattcctgcggtgacagataggtgtcgaacacgttggtgaagccgacaccgtacatggtggcacgggtgatgatgcggttacggctggcagagtcggcccgtagctgctgcgcaacattgttttcagtttcttgtgccttcaatgcgggggctcctaaaagcagactgcataagagtactgtcttatatagtttcatgagattcatttgctaattactaatcactcagtgctgaccgctcaaaacagtttcatctgtcctgtcatttcgtccagtatatccccttcacttttgccgtggtcggggtccagtatttccggctcttcatccgcttcctgtccttcgttttcctgcggaggttccggttggcgggtcggttccagctcgttgatggtttctatggtgtaggtggtcaggcgtttgccttttgctttgaaacctttcacggcgatgaattcgtcggcttccaccaccatcgggtcgcggaagttgtcatggcctccaaacacgacttccagacgcggatagcattcgtccgtcagcaggatgaggctgttgttcttgttttcgcccagataattctgtttgcgtgcggttgcctcgaagcagaaacgcttgatgtaaggatagttctgctggtcggcatcgtagagcacggcggtccatactttgttcgggtcgtatttctccaatacgcgtatgccgtcgtcgtagtggttgttcaggtcgaagttggtggcatagaactctccgctgttctgtacgacaaggatggtgtcttcgctctggaattctccgagatattctccgcgcccgtcgtagttgagacgtagcacatcacggtcgaaccagactttccgtccacccagcgtggagcctccacgttgtttcaaggctatcttgtgtacggggagtttcgtgagtatatttcccatcgcctgccgtcccttgatattgatattgctaaaatcctcctcgaaaatgatgcggcgtacacggggattgggcttcagggttaccttgatgatttcggcttcaccgttgggattggcggtaaaataggtgatgcgggaatcgggagtgccttgggtcacgtcgtactcgcggtcacgcaccacggaagtgacggcaaaacgcttgatatagcttgtcccctccttgccgtcacggtagcagacattgtagatggtacgtttgtcgttcttcttaaaaatgttggcataaagtatattcttgcccacgaacttcttgtcggccaccggtgtgatgatatattttccatcgcggaagaagataatcacgtcatctatgggcgagcagttgcctatgaattcgtctttcttcaatccagttccgatgaaaccctcttcgcggttgatgtacagcttttcgttggcttcgatgactttggttgcttcgatggtgtcgaagttacgcagttccgtgcggcgggggaaggctttgccgtacttgtccttcaacatacggaaccagtcgacggtatattccacgatgtttgccagatggcagtctatctcctctatgtcctttcgcatgcgtgctatcagttcctctgccttgtcggagttgaatttgaggatacgtgccatctttatctccatcagccggaggatgtcttccttggtcacttcgcggataaaagtcgggtagtagggagtcaggcgctcatcgatatgttcgcaggcggcatccatgtttttggcttgttcaaactccttatccttgtaaatacgttcttcaatgaatatcttttcgagtgaagcgaaatgcaggctttccagtatctctcccttacggatttccagttcctggcgtagcagtgccaatgtgttgtcgactgatttgcgcaatacatcactcacggtgaggaagtggggcttttggtcgtcgatgacacagcagttgggagagatgctcacttcacagtcggtgaaggcatagagggcatcgatggtcttgtcggatgatacacccggggctagatgcactaatatttccacactgccggatgttaggtcctctaccttacgtatcttgatttttcctttttcgctggcctttacgatggagtcgcatacactggccaccgttttcccgtaaggaatttccttaatggcaagtgtcttgttgtctatcttttctattttggagcgcacgcgtatcgcaccgccacgttcaccgtcgttgtatttggatacatcgatactgcctcccgtctggaagtcggggtacagcttgaattcttcgttgtgcagatagctgatggaagcatcgcacagctcattgaagttatgtggtaatattttggatgacaggcctacggcaataccttccacaccttgtgcaagcagcagtgggaattttaccggtagtgtaaccggttctttgtttcgcccgtcataagagagtttccattcggtggtcttggggttgaataccacgtccagtgcgaacttggagagacgtgcttcgatataacggggggcagcggcgctgtcacccgtcagaatgttaccccagtttccctggcaatccacgagcaagtccttttgtcccagttgtaccagagcatcgccgatagaagcatcaccgtgcggatggaactgcatggtatgtcctacgatgttcgccaccttgttgtagcgcccgtcttccatgcggcgcatggagtggaggatacgccgctgtacgggtttcagaccatccatgatatggggtacggcacgttccaatataacgtatgaggcgtagtccagaaaccaattctggtacatgccgctcagttggtgctttatattggcatcctttgcgtccgcaggtttgtaatccgagtgttcttcgctcccggccgggagttccttgtccaaatcatctttcggtgcttcaaaatcttcgctcatatttgttcgggaattgtctattctatgatattactgatttttcagtcgcaggcaaaaatacaatttttgttcgataaatgagaatttgcgcggaactattgtgccaaatccttcccattttttaaaacttctgcccgttaatggaaccaatctgtctctttcccgttagcggaattatattgaggacgtgcttccgcctctttgcggacagcgatgttgcttttgtctttcttgccgacaagttggcaaggttttgccaccacattggcaaagctttgccaaaggcatggcaaaactttgccaatatggtggcaaaacgctggcaaagtaacttgctggcttgttgtgtgttggctcgaattgtgcagcgatatcatcacaagggtgaagagatactgggcagattctgccgacggattcattattttgtgaatttccattcgtcaaataagaactttccgttcccgaatacgaagtaaatgtcgtgtttgccttttatccgtttgtccaacggctttgtcaatgtttgccacgtatcggtatcaaaggtcaaggtggataggagcggaccgtctggactgtccatgtgtatttcgatggagcctttcccttttatcttcatctgtatggcttgaggtgattgcgggaattccgcaccgcggacacagatggcctgtccgctcttgtttcctacggcagacatgttgcctgtctgtccggtaggttcaaaggcaacgccgcgtgtggcggctgtggtctcggcctgttgctgcgcaaacgggtcgagaggcttgatttgtgaaacgcccttggctgtggctgtgcccatgtggatagtgaggtccttttcgtccacctctatttcttccacgcagatactgcggacacccactttgaggtcgcggctgtcctgcaagcccagtgagtggtagaagagatagtacttcccttgaaattttaccagatgtgtatggttgttgctgtcggacatgccatagtcgccgggatttttgaagtagttgtcccgataggtccagctatctgtctcaagtggcgtgcgactcgtcatgtagctcatgcagcaccggctcggcttgtctatatccttgtggggccatgcatcccggttcttccagttggtgttgtaggtgtaaatccaagtgccgttcagatagttcagttcgtttgcttcaaagtggtatggcgcttttatttcaactatttcgctgtccagcgtcttcatgtcatttgccagccgcacgatgcgtgcgtctccgggaatgtagtcgtcgctgtcgcccccgccaaaggagagccagccgatgcccttgtcgtcgatgactactcccggatcgaagggagctttacacttgccgagtcctggagtattgccgtctaccacgcatttacccaatgggtctgtccagggccccacgggggaagtggcggtcagcatacctacaccggaaccgctgttggagtagtacagatagaagtgtgttttgccgtcggcctccttgcgcgaagcgatggaaggtgcccacgaagccattccccagggagccagagcctttacattgattactccgtgataagtccagttcaccatgtcgtcagaagagaccatcgtcagcgaatggatgtgctgataggtgtttttcccgttacggcccactacatcatattgctggtggtcgttagtgccgtacacataaatgcggccgtcgtgcaccactgctgtggggtcggccatgtattggaagtcgagaaggggattggcattgccggtagagaacttgggcgagaattcaaaagattcttccaaagcgctgtctgtagaaaccggaatgttttcagaagaggcaatgctgtctgcccggaagggggctaaggggatgccttccgttgaaaaaaggttgccttgagcagcgtcactgaagcagtagcgaatggaaaccggcccttcgattccttttaccgggacaatcagctttcccccgtctatcctggcccgggcctcttgccattcctggccggctgcggccatcatcagcccctctatccttttcccgtgtacggtcagtccgttctttatgtctttgaaagagattgtcacatggttgcctttgcggcaggcgctttcaaagaccgggcttttataggggcctgcatatatatggtatgtatcgtccagtgcaagattggcgagacgtttgcctacgcttcttttgtcacgtggatggatgtcctgcacattgtccaccaaatctgacacggtaatcatcttgaccttgtccagcatttcgggcaacatggcctgctgctcgcgtagcagtgccggtccgttgtctttggagtggtattggaagggggctatctggaccagatagaatgggaattccttgttaaatccggtacgccacgagcctatcagccgctgcatcacccgggcgtaggagctggcacggccttggttggcttctccctgataccagatgcatccggcaatgccgtagggcatcacgggataaatcatgctgttgtacaacgtgcctgtttcagccggaaaccaaggattggattcatacggatagtcgcacaagaccgggtcgctcattacgcattcgcggggcgtccatgtctcggcggtggttccgccccatgcggctacgatgattcctaccggcacgtccagctcttcctggatgttgcggccgaagaagtaggccagggcactcgtgctgcgcatcgtttcgggcgtgcactgtgtccattgcgagaaacagttttcttgagggaacggggcggctattctggccacgtgaaaaatccggagattgggacaatgggcatttgccgtttcctcgtctccgttctttatgccgtggttggcgctccattccatattggattgtccgctgcacagccaaacttcgcctagcatgacatcggtcaaggttacttctgacgagccgctgaaacgaatctcataaggtccgccggcttcgccggaaggtacacgggctgaccatttccccgtattattgacttgggttttgattatttctcctttcatccattcgggggcgatggaaattgtttctcccggaataccccatccccagaaagtaagttctgagttacgttgtagcaccatatggttggaaaatatggcagggagttgtatcgctgcttgcaatttcaggatgccgagcagcataaataaacttaaaagggtaagataatgatgatattttttcatacgagtatttatttccataatgcaaattaatagctgtttttagaaaccattacattttaaccgttacttttttcccattataagccactgccttttttgcgccatcagcagttactatgttgaatttccgttctttcaacataccggaaaactctcctttccgattttcaatagtgagcatgcgagtacggtcattccatttcatcgtaatggtgctgtacattcctttttcataattgtagttgtcattctcgtcttcgtaaagtgtgaattcgccgttacaaccgggatacacttttatctccaagttgtcccatgatttttcggtgctatactgcacttcgggacctattggcaggatggaacctgctttcacataaagtggtaaaatgtcaataggggtatctttcacgatatattgtccgccggagtgtttctgattggtccaaaaatcataccattccgtatttttaggcagatatattcgcatagacttaacggtactgaaatcttctacacggatggtgtccgaaactgtttgggtatacatgggttgggttacagggcataccaatagggatttgccaaacatatactgattgtggatgttccacacgttgcgatcgtgggcaaaatccattgccaaggcacgcatgaagctggactgattggcagttacctcccaggcagttgtgtagatgtatggtaacaaactgtagcgtaaccgaatgtatttctcaatcgcatcgtatattagctcgccttttttgccgaattgatagatttctctgggagcaccttccccatgtgaccgcatcatgggacagaatgtaccgaactgtatccaacgggcataaagctcgcgataatccgggtcatccagcatcaagggatattgccataggaagaatccgccgatatcgctgttccaatggggaatgccacatagtgagaagtttaatcccgcaggtatttgcttctccaaaacttcccatgatgctgtgatatctcctgtccatgtattggcaccataacgttgctggccggcaaaggctgagcgggtaaggataaatacgcgtttatccgaagttacggcacgctggtggtcgtacactccacctacactcattaaagggtaggcattgcgtactttacggaatgaccccaaataggtgggcgtgtcaaaatcttcaggaatggggtgaaaatggtcgggttcggtagagtccatccaccagccgtctatacccacagaacgtaggttctcgttcaggtacttccaatagatgtcgcgtgcttgcggatggtaggcatcgtacacgcgggcaccggatggatagtccatattgggaggccacttctcggaaccggattcgggccatgtgcggaagttgaagagcatgttccctttgtctaactcgcgatagggtttggtatgtggtccgaaagctgaccaaatggagataataatgtgggcgttcattccgtgtatgtcttccatcattttttgggggtcggagaattcttcgttcaaaaaatccattgcgttccacaggtagttgcttccccagtatctccaatcctggataattccatcgaggggcacacccagttcgcggtatttttgcactacgccaacaatctctttttggcttttgtagcgttcacggctttgccagaatccatatgtccataatggaaacatgggcacttgtcctgtgaggtagcgcatctgggcaactactccatcggcattttcgccgtacatgaaatagtagtcaatgcagtcgccgacttcagaaaggaaggatgtctcttcttgattgtctttgaagatggttggcgaatagttgtcccaaaagagaccgtagcctttgacggactggaagaagggaatcacatcctcaagattgtcttggataaggcgtttggtctggttacgttgcgacattttgccgttttgcaattgtcccaatccataaatagcttcgtctttctctaaggtgaacgattgataaacgctgaaggtttttgtgccggcatcgttgaaatcatcaaaacgtgcgcctttattttgttcctgcaacagcgattttccatcggaagaggcaaaagttatttgtccggtctcttcgttgagatggactgtaagctgatggcttttgatagtcaatatgccccctttcgaagagacggatagttttactttttccggttgcccgatgaccgacaagctttctttggtatacttccagccgtcaggcgattttaagattctcactgtgacaggagagaagaagctaatatctatatttataccttgcacagtgctttttatgccttgtgaggtgcgttggtaggtttgtgctctgccttgttctgctatgaaaaatgtcagcatcagcaggacaaatagtcttaaaaaaaatccctttttcatacaatatcagcagtttaacggttagtgattttcagtaccaaagaaataggattgggtgtcttgtctttgggaaggtcaataagcaagcctttggaagttcttctgaactttgcctttccgcctcctaataattctaccttttcgatttctcctttgcagtagggactgccggtagccagtgattttatctgtatttttccgtctgagggccatttcatgatatgggcatacaagtatttcccttttttcacaaaccggatgtcggcagaagtgtagggtgcgttcttgtcttcgttgaatcctgctccgtccaaaggtattgctgtttctgtggagggaccttcaccataaatacaccagggacgtgtgtcgaatattccttctccgttcacctccatccaggcggctatgtcttccagaattttttcttccttgtcgtcgatggtgccgtttcctttcattggtacgcttagtaataggttgccatttttactgacgatgtcaatgagcatgtggatgacggtcccggctgatttataccagttgtcttcgtaagcagagcggttatagtgccaagtaccgaggcaactacaggtttgccacgccttgtcctggcattccgatggaacccctttttctacatcccatacgatggcctctttatgtttagcttccagcttctttccgaagactacagcattgagattgcccttgtgaagcttcatgttctggttatagtagtgcgacacgactttcagccccgtatcgttgatgggccagaaggggagtacgctgtcgtcgaaatagaccaggtcgggatgatatttgtttatcatgtccactgtgcggtcgaagaagttgtcgtagtaactctgcggggggacagaggttccttcgggccagtcccatgccacccaagcatgtccgctcagggcatgattctgtacgtatagctcttgcgggtcgtagccttcccaccattttcccttgccgtcttccttagtcactacgcgggcatcgtaggagattcctgcgtatgggcctttcttgtcggctccttgtgcagtttcataccatgtccaagcatgggaggagtggatgctgacaccgaagggcagtttgtttttgcgggccgctttctcccattcgcccagtacgtttcgcttggggcccatgttgacggagttccatgattggtatttactatcccacaagtccatgttgtcgtgatgattacccatggcaaagaaatatcgggcaccggttttcttgaaaagggctaccagcctctccggattccatttctcggctttccattcgttgattacatccttgaagccgaattccgaaggatgtccgtaatgctccaagtgccacttgtaggcagcaccgccctcttcgtacatgccacgaccgtaccagtcgccggcttcgggttggcattgcggaccccagtgtgcccatatgccgaatttggcgttgcggaaccattcgggcacttcgtattgggacaatgactcccaggtgggtgagaacttgcccggttctgctttctcttgttgtgccaatgcactgcccccttgcaggatgcaggcggataggagaattgttttaaagatgtttcttttcatacctttattgttgtttacaaaatgtttatttcctttttgaatgcattgatgaacggattattctgttttgtccatatactccatgataaacccatatcggtaggagcgattgccgtcaatggtgtatggcttcatggtctgtgcgccccatccgtcgtttccacctactccgtgtatgttggagtcgatattcaggttgatgaagtcgcgttcgggcagttcgtgcgcatgttctttcccttccaggtcttcttccccgtagggccatatacggaaacataggggttgcaggcctttgacttgtattttccatcgctcactgtctcccagcatgaaccagcgtgtatcgcaccggttggcattgtcttgcggtacgatgtagttcgtgataaattcgtgtatgccacactcgtagcctcccaggaaagcggagctcttgcggtcgggatagttctcgaacttgccgcgtccgtaccaggctatccggttcagcgccgagggcattctcatgcgcataccgaatttgggcatcagcggaatatcttccttttcaggctgataggttgcttctacttgtatgcggcctttgccgtccacagtgtagcggagatggtaaccggctcctatccgggggagggagagactggcatccactatcaccataccatcgtttacggttgcttggtatgcctttacgatacgtttttgctctgcatttttccaagcgctcaaacgttcattgtagccgttgcggacctgaatgtcatttgccggtttccaaaaatagggttccaaggcactgtacaacaactcttctcccttgactcgccaactcaccaaagcaccggtacctttttctatggtgaacaaggcatcggcggctataatttccaccgcttcgggtgtctccttaaacgtggccttcccgccgtcatccttcaattgtgggaattcatagtcatgatacgtaagttgttccttggcaactttgaagcccttctctgcccacgtcgtggattccttcaacgtggcatatacattgaggcaaagttccccacacttatccggtcttgaaggtacctccagcagattcccttcggacaactggaggtcgccgctgcttactgcctttccgttacatatccactcatagctgtaatcgaactcatccaaatcggaaaacgcatacccgttggtcaatttgatttgccgcgttcccttcttttcaaacttgatgtattgatatactttttgtacctcatagtagtgggggtgaggcacccggtcgggagataccagcccgttaatgccggtgggaccgtcgttgggatagtccccgaaatctcctccatacgcccagaattcatcaggcagtaatgggagtgacgaggggctctcgccgaaacttaacggtgcaccgttaagctttttaggaatgccttggtctacccagcaccaaatggcagctccgataatactttcgtccttttcaatcacatcccaatactccttgaggttgccgatggaatttcccatggcgtaggcatactctctcatgaatacggggcggtcggttattttctcgccaagttccttcaaagcgttgggatgcagataagcttcgtcatagacatcggatacggtgcggtctgtatcgtcgtatatcggtctggtggggtctaaggcacggattgtgtctgccatagctcgcaaattggcaccgcttccaccctcgttgcccaatgaccagaataggatgcacggatggttcttgtccctttccaccacggctactgcccggtccacatgggccagtgtccattgagggttgtctcctaatactttgttccccaaaccgtaggcatgactttcgtggttcgcttcgtccattacgtagattccatacttgtcacatagctcgtacagcaatggcagatgtggatagtgggacgtgcgtatcatgttgatgttggcttgtttaatcagccggatatctctctccatcgtccggctgtcgacaaagaatcccatacggggatggaagtcgtgacggttcactcctttcagcttgacggctttcccgttgactttgaagacgtctcccgcgatttctattttccgtatgccccaatggtattcgaacgattccaaaagttcattcttcctgcgaagcttgatgtggatgtcatatagatgcggtttttcggcagaccatagttgaggctcccggagcatttcggacagtgtgacgctcgtttcagaaaaggcctgaatagtacctacgggagccaccatttttttgtcgagtttatttcctctgttgtctttccccaccaggtttatttctacggtcaggtcttttactttgcggtcggtctggtttcttatccaaatttcggttccgaatgtagctgaacgcatgtcgtccgacaagtcgctgctgaacctatagtcccggatatttgtccggggacgtacccatagctctaccggcctgagtattccactaagccgccacatgtcctggtcttccagataactgccgtccgaccaccgatacacttccactgccagacgattggctccgttcttcacaaattcggttatgtcaaactcggcaggcgacatcgaattctggttgtagcctacccgctctccgtttacccagacatacatggccgattttactccttcaaagtgaaggtataggtacttgtctttcatatcgggcgtcacttcgaacgtggtgacataagagcctgtgggatttctgtgcccgtaactgtaatattcggcgggaggctcgcttgtcactctgggtgcatccttctggaagggatagtttacgttggaatagataggtttcccataaccttgcaattgccatgctcccggcactgtgatggtatcccatgtgtcggtattgaaatcattcttgtagaagtcggccgggcgctttcccgggtcggcagaccattggaatcgccacttgccgttcagggatatgatttctttgcaatcgactttttgcgaaggcaatgtcagtgtggcatgatacggctctttgttgatgccgactacaataggattctcccagtccggagcttcttgggcgccggcatatagggcacttagcaatagaaaggcaaatatcttttttctcattttttctcatgttttctgatggtcaataaacttccatgatgagaactccccaggggggcaatgttacatggtctccttcttttacagtcttgccggaaatcagctctttggatgtcggatagttatgagtgatttctttgctctcgctgctgtaattgaagaagtaacggatggcttttccggctttgtttattcccgaacgctgtatgatggggaacacgtcactctctgaagagatgataccggcatggatggctgcctttcgcacgatggcattcagcaattcctgtgaagggtaggctcctatgtaggtcagtttgcctttgccatacttgttttcggtgacaacgggccatttgccgaagaacggatgctctgcataagccaacggggtggctgtctcgggaatcaggaattcataccagtcgcttatctggttctttccctctaattgaaaggggttatcctttaatgataagtcaccgatagtggagaattcctggtaatggaagccgcaggctttgcgtagcggcccgggagccaaggtggcccgaactgcggagtgctcattgcagtaaccgcttttgtgcatcattaccacgtgtccgccggactgtacgaattcatcaatggctaatagcaattggtcggtagccacatacaaagggggaatgacaagcatgtcatatccgctgaaatcggttgtcttgtcacaagggatgatgtccgtttctatgttttggaaatagagggctttatgcaccatatcaatgggataattgctcttgtaagtgtagggcatgaagccgagagcatgataagaatcatgactgtagaggatagctgcccggtttttctttttcaagttcacgatgtggctgcctattctttccaactctttggcggtggtggtgaattccttgtatatgcggttgggctggaggtcatggcccagcacgcctcgccagtatgtctcctgcccgtagtgcagggtagaccagtgccagtattccaccatattggctccggaagcataatgtgcgtacacattctgccgcaactggttgtcgtagggaggaaactgggtgcgggcatcccagccgatgccttgtgcgttggtttccatgacgatgtaattgttgtcggccacggtgcgcacgaagtcaccggcataagcgatgcgctggccgtcttgtttatcctgtacatcgtgatagacattgatggcaggatattgcatctgcctgaaactttccacttggtctatattatggaagtcgggcataaagcagtgggtgacaaattggtctttacgcttgtattcatttacaaggtcgcactgccaattcagaaaatcggccacttccttccggttatagcgttcccattcattcttgtacgaggggcttgtcactccatcgcgcggatagaactcttcccaggtgttgatgttcattccccagtagttcattccccattccttggcaagcagattcaggtcattgttgaatttctgtttgatgtagttcctgaatccgaagaaatagtctctgttgtttactccgcgcgcttctgtttcgttgtccacttgatacccgatgactgccggatgctgtgcatatctttccagcatcttgcggataatccgttcgcaatagaattggtaggtcgggtttgtaaaatccatgttctgtctgattccataataggctttgtttcctttggcgtgttctgccagcacttccgggtgtttgtatgccatccatgcaggaatggaataggtgggagttcccaagatgactttgattcctgctgcatgcatcttgtccagaatgcggtccatccattcaaattcaaaatttccttcttgcggctcaaatactccccaggcagattctccaacgcgcactactgtcaggccggctcttttcatcagccggatatcttcatccagtcgctcatagggcatatattcatgatagtaggctgcaccataaagcacgttgtcgaatgaatactgcgcttttatttgtaaagcgcttaaaaacaacactaatagaataaagtaatttttgtttttcataatcttaccagtccgatacaatatttttatttcatcataggtcttatgctgatggttctccgatattcctgcggcatcgccttgtaagcaccgaatacaccgcgggccgtacagccgaccccggtagtggcataatcgagattcagggtcatgcctttctgcttctgcaattggtaggtatacatcgctttcgtcagattgtctgtgctgtacggataaatgttgaagttgaaccattcgttcatcttgaattgaaggccgatgcctttgtccgtggtcagttgcagccagcgtacatctgtccgcaatccgtaatcttgtggcattagatagggctcgtacatagcttgtacggtagaggcatatatccccatcggatagccggttttccggtccggatagttctcttgcggtcctcggccgtaccatttcacttggtcgagcgcatcgcttacggtcagcgtaagtcctatgcgaggaaaccaaagcggcattttcccttcaggcttcaatacatggcgtatctctatcgtcccttcactattgataatatactcatagtggttgatgatgccgttgttctgtactccttcgatgtagaggtcttttttctctttttctcctttgcccatcaattccgcatcaatgatgtgtatatgtacgccttcggtggtttcggacaccgaaaaagagaggggctgatgtgtcaggcggtcaatccctgcagaatacatttctgtggctaccgtgtatccgtaaccttctttccagttggaggagcgggcgctggaggcattccagttgtccagctcattggccagcggggcacgccaaagattcagccggagcggtgattccagcagttccatatcttgaacaaccatcgacgtcagttgtccgtcggtacggttgaatacatatttgaagccatctccggagacaaccaattctttctccgaaagtgaataggaaggtacgccttgagccttttcttccgaagagcatggcaggctccaaggcagttcaagttcttcccatgccacctcatgtccggcttttgcccacaattcatcttttttcaggacggcatgaagcatcaggcggtattctttgccgggaatcagggctggcttcttataaggtatgtgcaccagctcttggctaagcggcgctgttgagagtgccaagtcgcccgattgaataaccttgtcatcttctttcaattcccatcgtatggcatatcgggaagcatttgtataatgattgcgattccataactcaacgactccctctgtcacatccgacatggaaaaagaaagaggttgtccggttttcttcatttgccacatttcgggctgtacgctacggtcgggccagatgctgccgtacgtacgtgcaccgatgccgtaactgtagaatgtaccattttccgtctcttgctcaaaatctagccacagagcggcttcttccgggtgaaaagaggaagtcagtgccttggcgaaaatgccgacttcgtccatttgagcatcgcagatgtagaccgaagtctcttggccgtgtgtttctgcattccgaccgatgttgacggggtaggggaagttccggatattgcccgatgcttgtgtggaggccttttctgctccgtctatatagatggacattttctgtccgtcgtagacgcacgtcacttgatgccagttgtattcccagtcagtaggcaaggaggcgcatacggaatgctttttatcagtatagatataaaattccagtttgtctttaccgcgttgttgcagcccgaactgataattgccttttgtgatgaatgagccgcaactgcttaccagtttccgggggtagattctgcaagtgagtgtcagttcattactgttcaactccacattgtctgcacgatagacctctacccattggtcgtgaccgttcaagtccagcaccgtgttctttccttccttcaccaagcgggcatttcccatcagatgggcgggagtatggaagggcgaaaggtcgtccacttgccttatccgttcggtcagtcccggacttacaaaatcccagatggcccctcctatcaggcggggatgtcggtagatggcttcccaataatcgtccagggcaccgccggcattgcctgcaaccgataagtattcatccataaacgatggccgggaatcctctcctatgcctacctgcatttccagttccataggagtagggtaacggggtccgataatatcttctgccggatgggagaatgcatttccgccatacatccagaagcgggtggggtccagcgatttcccttcttcaatggtgtgggtaatgttgataccttcaccgctttcgtttcctgcgctccagaacaagacgcagggatggtttctgtcccgtaacaccattctgcggcatcgctcgcgatacatctcttcgtattccgggagacttgaaatccattccgaggcatgggcttcatcgcccacctcgtctatgatataaagcccgtattcattggccagttccaaatacttattcaccggaggatagtgagaggtacgtacggcattgaaattaaactgtttcaacaattcaaaatccttgcgtatggtggcttcgtccatgacatgtccctcttcgggatgctgcatgtgcgaattttgtgcattgactttcagtgggataccgttaagataaaaaacaccgtctttgatttccgtctttttgaatccgatgaccgtttctatcttgtctttctgcagaccggccggattggataattccagaccgagcgtataaagctcgggtgtctcggctgtccatttccggggttcttgtaccaaggtatgcaactgtattgtcttttccgcagcgtccatttcaaatggagctgcggaaaagttacagataatcttgccgtttttatcctttaagtaagctttcaatccataattctcatttggcttcttttggtagtccttgatttttacctgaatacttaactgcgaatcggtatacgtattatcaaactctgtgattacttgccagtcgaatatcctgacagcaggtgtggcgtacaaccatacgtcgtcaaagattccggccagtcgccaataatcttgtccttccaggtaatagccgtccgaatactttagtacacagacagccagcgtgttttcgcccggcttcaaataaggagtgatgttgtattcggcaggttcttgtgctccttcattgtagcccacttcatgaccgttgacccatacaaaagaagcggatgccactttctcgaaccttaaaaatatctggtcttttgctgcccaacttgcaggtaccttgaatgttcgccggtatagtccggtagggttatactctttgggagcatgtggtggattcaccccgaagggagcagatacatttctgaacagcttgtcaccataaccttgcatttcccagtttgagggaactttgatgtcgccccattgcttatccgggaatttggggttaaaaaagtgtgcaggtatcccttccggtgtatcgcaccagaaaaacttccatgtcccattcagtagcatgctcttttcgggcatatgccaagcgtgtccttcctcttgtcctttttcaaatacagaagggttgtctatataccagagcatatccttaaggaaggatttgtcttgtgcataggattgcaggcacaaggctactgaacacaatggcagaaacagttttctcagattcatttttttgtaattcgtgctgtccatccaccgccgggtgccagttgtacattgagtttgtctttggcagtgacgatgcgtacttcttttttatagtcggtagcttcacggtcggcattgatgccgtcggcaaagatttcggcttcgtagttgccttcgctgaggaaggagaggtcgatggtgcagctacgcggagtccagttggtcatgctgcctacaaaccaagtgtttcctttgcggcgtgctatcgtgatgtattcggctattttaccatcaagagcaatggtttcgtcaaaggtagtgggaaccttggcgatgaagtcggtgcattcctgttccttcatgtatttgctgggactgtcggcaagcatctgcaagggtgcttcgaagacggtgtacatagccatctggtgtacacgtgtaccttgactcatggggtggtcgttgacggagcggaacagggaacgggtggcatttaccatagctcccggcgtatagtccatcggaccggcgagttggcgcagatagggggcggtaacgtcgtagcgcgggaagtcatgcaagggtgcaccgttcacgatgggctcccacttgctgttttccagtcctttcacaccttcaaagttgaggatgttgggataggcgcgctggatgccgaagggtttcagtccgtgtaggtcaagcaacatgtgatgcttggcggcacatgctgcgagttgttcggtagaagagatggcgagttggtcgtcgcggtcgaagaagtcaattttgaaacctttgattcccatttgtgcgtagtggctgataacttgttccacggcaggggagatgtcgcctcctcccgtaagattgcgccagcttgcccagaggatgatgcctatgcccttttggttgccgtatgccaccagttcttcgagattgatttcgggactgatgtcttccattaatgattcctttccgctccaaccttcgtcgatgatgatatactccagctggttttcggcggcaaagtcgatgtatttcttataggtgggcgtattcatgcctgccttgaagtccacgccggtcaggttacaagtattccaccagtcccatgccacttttccgggtttaatccaggatgtgtcagcgatgcggcattcgggtgcgaggcgttgcatcatgtcgttgttggcgagttgtgtgtcgtgggtaacaacaagcacggcacgccaaggataggtctgtttccctgtgggacgcccgttggggcagaagtagggggcattgttgggcttgctgataacgtcggcacgtttggtagggacgaggttcaagcggtcatagcctccgatgactgtttccagtggatagggggcgaattctgccttcactccgtggggcatctgtgggttggcagtgaggaacatgccgggatagttggacaatccggcttccataatgacggctttctttccgttctccagttctaccatcagcggagtaatggcaagcgagtctttgtacatgcgagagaggggggcctcatcgtagtaggactcgaaggagtagcagtaacgctcgccggcgcgattgtcgttaatatagggcacgaaagcgtggtaatcgcggtcgaagttgaactcggcaatctcgtccttcacgcagaaaggtttgcgcagttcggaaacaaaacgataggcggctccgtcgtcgtaggcgcggaactgtatgctatagccgttacggcatttcagcgtgagttggttataagtgtccttcacactcgcctttttgtagaaaggagtggggaaggaagtgtcgacggaagtgcgggtagctttggtcaccttcacatctttgccgaaggtgaaagcaatgggctttccctcagattcagtgcattgcatggcaatgtctgaaggcaaaagaacggtggtaccgtcgtgggcaatcgcccagttgagggcttgtccggcttcgatgttgacaattagttttccgtccggtgaattcagttgatattgctgtgcttgtgccgtcaatgcacaagaaagcaataggctggcgaaacaagtgctgattctgttcatttttatttgattattgattatgaatatttgtttaattccgtggatatttaaccggaatagccatcatttcttctaagaagagagggtcgtcgaactggcaagtctgtcggttgtattgtccccccggagtgtcccatagcattgggcacatgccgcgcgagtagatggcttcggttacggaaacacagaagagtcttatcacttcctttgttctgtttctggagtcggcgcaatattcgcctatgatgacggggattcctttgtctacgcaattcttcttcagtaggtccatattgtcgttcagttccttgaagtcagcttccgttccccagctttcccggcctacaccccaatcgacaacctcgcctccacccagtatggcaaagtttgcgggagtatagtaatgcactgtaagagcaagtcggtttgcgggatcattcggcatcttgaacaaggggtcgtaagcatactccaagttggtgttgtagatttccaccaacagatgacgtttggcgttgttgccgccactgtttcttactatgtcgacaaagagctggttgaggtcgttcacgtatcccagtgcctttgccttgtcggcttcactaccgccccacggagtccaaatctcatcgtatccgatttcattcattggctcgaacagtaagtggtcaccgtacttttcgaagcgttcacatatctgtttccagatggaagtgaatttttcttttgctttgctgtcggtgggtacttgtttaatccattcgttttcgtggtggatattgatgatagccaccatgccacagtcgagggtccagtttaggattttctctacgcggtccatcaggtcaggatgcactttgaagtcgtcggacagcagattgccccagctgaccggtatgcgcagagatgagtagcccgctttggcatatccttcaatgatttcttgtgtgataatagggcttccccatgcttgttcgtaattgagaatgttgcttgggtctatccagtcgcccacggcatccagcgtgttgcctaggttgatgcccagtcccatttcgttaatcagttggtgggttgtgagattctcgcgtacagtgtatttttccggttcatcgctttggatataggccgcctgctccacgttgatttcttgtatatgctcctttacgctgacggtgatgatggcgttgcgcacgtcgggcgtagtgttgggttctacggttatgttatagattgcctgtacgggagtgctgctttccgaggttactttgcaccatgcttccgaactttggaaagtggctggttcattgggggtgataccgaatttcttgctaccacccgtttgttcaaaatggaaagaagtaggctctacgatgattttcagctcctttttatcgtcagagcaagctgtcatcagaaatagaaccaggctggttaataaggttttcttgaagatttgtgtcatggtatcggtaaaatttcgttttaataatttcggtgtatttatttttagacgctgattcaattgaatcagcgtctaagagtttaaaagaaggtgtcactttgtgtaatcctgtgccagaatttaattcaaattattgtatcttgacaactcggaaattatcaaaatacatttcgatgttgtatggaccgttttcgctggggtttgtcatctggagtgccaactcgtcaccgtcacgtttttggaactcgccccaagtggtttcgtctaccagttcggagagcggaatgctgcactgcatccattggcctacttcggtttttccggtgaagtcgctcaccggacgatagttcgtgtagttgtgagcctcattccctttgaggtagatgcggaatacaggaccttcgccatattccactgccacgaagcattcgaactgcaaagccagttcggaagtcggtgtatcggtaggcaggaaggctgtgtcaatgccccatacggcaccgttctgcaattggccccaccagtaattccatgctgaaagttcccctgatatgctgtagcatttaccatccgagaagaaaggagctgctgtaccgtcggcagtgacgggtacagcttgcccgccccaggagaaccaaccgatgttgtcatagttcaatactatattctccaaaggatagaagcccggaacttcggcagtaccgcccattgtggtaatggcgagtgagcaagtgccttgcggtgcacgcggcatggtaaaggtaagcatatcgttagcttcgcttacggtaacagtagagagatctaccgagcgattgcccattgtgatggaggcgatatccataaaattctgtcccagtacggtaactgtggtacccgtgataggcatcatggagcttaccttgctgatacttggtgggagggctgtgcgacggaagggagtaaatgcggatgcggtatagcactccactaccagactgccttcatcaatcaggcctgcgggagcattgaatgatatttcgtcaaagttcttgtttaccgtgtagtccgttacttctaccgaaacaggtgcattggtgatgtcgtccacggcagtggtgaaataaacgcgctgaatttcgtagaagttaccgcccacgatgcgcagaggcgtgcccgtctccacggggaaggttgtggctacacgggtgatgtagggtgcgggcgagagtacatgcatggagtacgtggcaatgccgtgcgaggtctcgatacgcagttcgcctttcagttcggggttggcacccgtcagttgcaattcgccggggatagtgaggatgagactggtggaagtgccgtagttgctattgaacgaaacttcttgttcgttgatgaacactttccgcacatcattcagattttcgccgatgactacaatcatggtgcccggatttacatcggtgaacgtactgtcggccttctctgggtcgacaagacggatgtggtggattacgggaacaccgccgccctcgtcatcgttgcaggcggtgaaaaggttgcatgccaacaggatggtgagcaacacaaaaggaaaatgtatatatttcatattaaagtcgttatttgagataatgaatgtataacttggtttattcactgaattcgtatgctaccggttcttcgttcagtagcggattctggatgacatcgctttccggataaggcatcaggatgttgccgtggtggatttcgatgttctcgcccggttcctgccaattttctatgccttcgaggaaagtgtcgccttctttcttgccgaagtggaggtaaccgtcttcgtctttcacgatgaggtctactgtgtagccgcggtgttggttctggaagtaattcagcatgtagtcgggtttccagtgataccacgataccatgtcataccagttacaatactccatcgagaactctacgcggcgttcgcgaatgatgtcttcgaaggttacgcgttccttgcgggggatacgtgcacggtcgcgcacctggttcaatgcttccaggccgggaccaccggccagttcttcgctgttgcccagacaagcttcggcataggtcaggtaaacatcggcaaggcgtaggatgtaggtgttgagcggagagttcatggactggatataaccgtcgttgtcgtcgtccggaccgcccggtacaccttttttaatgcaagaggtggcgccgtcgtaagtataaccaccgtcggcaatgcagatgtatgaatagtatgtacccggtgtgcagaaggtggcgttgcggcggatagtgtcgcccaactcatattgctggagcatatctatacttgcctgatagctgctccatacgtttacaccgccggtcatcttgctgttgccggcgaggtcggcaagcagagtgttgcatacgccccaatcacccagtggcacccactgcatggcaatgagcgattcgggattgttgttgtgcttatacttgaagaggtcttcatagttttcgtaaaggctgatgccgctgttgtttatcacgtcggcggccagttccttggctttctccaggtcggcgttgtcgcgtgtgcctcctttccagcctgagcgggcgaggtagactttggcaagcatgccttttgcaccccatgcgttgacacgtcctttggcggttgccacttcaggaagattctcgactgcataagtgaggtcacgaataacgagttccagcacatcttcttcgcggtggagcggttgcatgggattggcaaccactttgtcgttgtcttcgatgatgataaccggtccccagaggcgaaccatgtagaagtaggcacaagcacgcatcaggcgggcttcggcaatggctgtgcgcttggcacgttcgcttacgctgttgctacatttggtctgcacatcactgataactgcattggccattgtaatgaccgagtagaaacctgtccatgcattggcaaggttttcgctcagggctgtcaccttgaagttggtgaactcgggagctccccagcgactgaagttatcgttggcacggttactgcccagcggcacgatggcgcgggagttgaggtcgaaccatgcacggttgtaaagcggtgcagtggcttgttcgagtgcatcgtcggaagtgtagtatgtcacatctacgtagtttccttcgggagcacgttccaaaaatgagtcgctgcatgccgtaagcagaaggagcgatgatataagggttagaaatctgtgtttcataactatattgagattttaaatgataaatgatttgtctggctcattagaaattgaagttaaggccaaatgtatagatacgttgcgaaggatagcgcgcatcgtccacaccacgtagcaatacattgtagttcaaagcgcctatttcgggatcgtagcctttgtagcctgtgatggtacagaggttctggatgttgacgtagaggcgcagatggtctatctgcaaacggcgcaaccatttctgtgggaaggtgtaccccagcgagatgttttttatgcggaggtaggaagcgtcttcaacaaagcggtcggagatacggttgttgtcgttggcgctactggtagtgatgcgttgtactttggctgcatcggcgttggccacgtaaacattggaaagtacctcgtcgcccacttcggggtcatgcatggcgatttgggcaatgccggtagcttctttcagcaggttgctgttacgcatgggatcggtgaaggtgcggcgaatcaggttgatagccttgttgcccaccgagccgttcaggaagatgttgaggtcaaatcctttataagaaaggtagttgttgaagccgaacgtgaatttgggtgccggattgccgaggaacgtgcggtctttctcatcaattacaccgttgttgtcgcggtcttcatagatgtagtcacctacccagatgcccgatttgccgatggtctggtctttcgggatggctacttggatgcggttgcccgtttcgtcgagcaggaagttgccgtcggcacctttcttgtagaaatctccttcttccttgaacataccgattactttatagccgtagaactgcccgaccggttcgcccaccatggtgtaggtcagtgtttccgaaccgttgattcccgaaatagcggatgattcggagtagagcttcgtcacttcgttgtggttgatggagaaggtgagtcctgaggtccaggtgaaatcacgtgtctggatgttgtgcgtgttcagggtaaattctacacctttgttggtcatggcaccggcattgacccacggtgcacgaatcagaccgcttacgtaggtaggaagagaagcttgcatcagcagattgtccgttttcttgtaataagcatcggcgatgaactctatgcggttgttgaagagggcgaggtcgagtcctacattgaaggagtttgtttcttcccacttcagttcacgattaggatagttgcctgcatagaaaccagtaccccagatggaggctgccgaagccatggtgacgccgtaggcataggaacccgcccattggttacctactacaccccaacccaggcggagtttcagtgagttgatggcttccacatctttgaggaaagcttcgttgttgactttccaagccaatgctaccgaagggaaccaaccccaacgactttctttggcaaacgaagacgaaccgtcggcacggagcgtagcggtcagcaagtagcggtcgtcgtagttgtagttcagacggccgaagtatgattcgatggcggatgaaccacgggaactgttggcttttgctgttgtggcatcacccgcatccagttcgtgtacggagttgaagaggaagttggtacggctgccgctcagcgactcgtacttgttttcttgcgcttcgtgtcccagcatggcagagaggccgtgtttgccgaaggtattattataagtaaagtaagttttcaatgtccagttgcttccgttgccggctccacggcttgctgacgactgctgcttgaagtgctcgtagtcgtaggagggggtaaacttatagtcgttgctgtaattgaagttggcggcatattccgtgcggaatacgagtcctttccacagcttgatgtcggcaaaggcgttgacatagacttgtgtgttgcgactatagttttcattttggataaggtcggagagggggttggagaagtaagttccatacatgttctccgtctgcatgccgaaactgccgtccgggttgcgggcaggcacttcggggagctggttcagggcattgtagatggcacccgaaccgtctacgttgttggtctgctgtgtacgggctacggaggcgcgcaagccggtggtgagccacttgttgatgtcgttgtccatgttgacgcggaaagagaaacgctcaaagtccgaaccgaatacaataccgtcttgctgcatgtagccgccggagagcgagtatttcatgctcttcgaacctccggagatgtttatctgatggttgtgcatcggggcagtgcggaagatttcattctgccagtcggtaccgcggctgaggagtgaggggtctttgaactcttcgcgtgcaccgaagccgatggtggcggcgcggaggttctggtaaactgcatattcggggagtgtcagtgtttccagtttcttgggaagctgttgcaaggcatagtaaccttcgtaggagaccttcgttttgccctcttcgccctgacgggtggtgatgagtactacaccgttggaggcgcggctaccatagatggctgtggccgatgcatctttcaatacttccatggaaacgatgtctgcagggttgatggaactgagcacgctgctgttgctggtgttgttgcctgagatggctacaccgtcgataacgtagagcggttcgttgccgttcaaggagttgataccacggatgctgaccgagataccgccacccggagttccggaattctgggtcacctgcacaccggcggcacgtccttgcaaagcttggtcgagcgaggtgactacggactttttcagttcgtcacccgtcacgctgactacggaaccggtcaggtcactgcgtttcatcgtaccgtatcccactactactacttcgtccagcatctcattgtcttcttgcagcagtatgtcgatgcgggtggtgcgctctactttcacctctttggtgcggtagccgatgtaagagactatcaatgtttgtcccagatttgcctggatggtgtaacggccgtcgatgtcggtaatgccgcccgtattggtttctttcactttgacggtggctcctacaagtggctcaccgcccgattctgatttaacgataccggatactgttttggtttgtccatacgtggaaacaatacccaaacctagtaacacgataacaagcaattgtctcaattttgtccattcccattgagagcatacatttgcgtgtaacttcataatactttaatttaagatttaaaaataactgttattaaaagctactgcaaatatggaaagttatcataatagcataggtctatcatgtctcaaataacatacctttatgtttcaagttatcattttagactgcggatgtaatcagatggtgatattccaaattcattcttgaagtttacagtgaacctttttggagaactgaatcccacctcataggcaatttctgcaatttgtttctggctttcctttagaagttgcttactgcgcttcaaacggataatccggatgaattctgccggacctttaccggtgatacacatcagctttttgtagagatggctacgactcaaccccaattctgctcctaacatttccacagagaagtcggaatcactcatgcgctcttctactattttgatagctttttcaataaattgttcgtctagtggagtgattgttatttcattaggtgtcacttctattttctgactgaatttacgatggcttttttctgtccattcaataaatttcctgatgcgcagctttagtaatttgaagtcaaaaggctttacgatatagtcatcggctccttgctcaaatccttcacttttgtattcttctgccatacgggctgtaagcaatataacgggaatgtgggaccattgcatgtttgttttgatttgccgacatagctctgttccattcatcactggcatcatgatgtcgcttattacaatattgacactgtttttttctaatatcttcaatgcctctgctccattgtaggcaacctgtatggcgtattcatcggacaggtattcagacatgaaactacagaaatccttgttgtcgtccaccaacaagatggtataccgcaattcttccgcatttggaacgggaagttcattcggagctttgtcattgtttagcagttccggaagtaattcctccttttcactggcatatgtgacgataggcaatttaacggtaaatacggaacctttaggaaaattgtctgtaacggagattgttcctttgtgtagatgtacatattcgtttgcaatatgcaggccgattccactgccggttttttccgaagtttgttgcacctgataaaaacgttcgaagatatgtttcttgtctttgtctatgataccttgtccgttgtctgccacacagatgcatacattgtcatcttcgcgataaagatgtacattgatttctcctttatcaggagtgtatttgaaggcattggacaacaagttgttcattactttttttattttaaccggatcgaaggacatgttcaggttttctacttcgcacatgaaacagaagctgatggtatggtcaagagcatactcttgaaaagtactgcaaatctcgcggataaagttgacaatatctcccgatttataatgagctgtctcggctcctacatccagtttccggaaatcaagcagagagtttatcgatgtaagtaattgttgtgcatttttattgattgtatttagttttttgcgtattccgtcatccagggtttctgacaataacatttgtaacgggctaatgataagcgtcagtggtgtacgtaaatcatggcttatatttgtaaagaactttagcttcatctcattcaggagcaacttttgttcttgctccagttttgctcgttgttgctccagtcttatgttgtgatgctttttgaatcggtatattacataggatattataccaatggcaaacaatatgtataagatgatagcaacattacataaatatattggagatgaaacggttatattcaactcactagcttcgtcattccatataccgtcactgttacaagctttaatcaatagtttgtaattgccaggaggaagggtggtgaaagctactttgttctcgtttgtatagtaccattgggtatttaatccttccagtttataggcatatcttattttatcagcattcagcaaatcgcctgcggcaaattcgatggagattaaataatcgtcatatctgacagacaatgatggggttctgccaagtacagttgttaatagtttacgcccttcatatattgagtctacttctatatgttgattgccaatggtcagatttgtaaaatacacctttgccagcggtcggctcttttcggtcagcttgttcggatttatagatgtatagccactggtgcctcccagcagtaaatctccgctggacaatttacaagcggaatgggagttgaaatgattttctggcaatccgtctctggtagaaagattcttgaaagaaaagtctactccttcctgggtgtctggggttacttccaatatagacaatccgttacttgttgcaagccacatgttaccatgattgtcttgggttatactgttaatgagattgtcacacaatccgttgtttacgtcgaaccagtgtagtgaatcattttttaagtcccaggcagtcaatccttgtttatgggctaaccacaatatatctctgtcgtccttgaatacagtggaaatgaagagctgcttgaatggctgtgtctcttttcgattggcataaatcatttcgggttttctcgtcacgatgtccattacacagagtccgtatgtagtcccgatatacattttgtctccatagtcataacagatattgagtacattgatattattcccatcaggtagtagataacttgtcgcagtatttgtgtccggattaaaacaaaccaaagtttccagtacataacctatccataagtttccatatcggtcttccttcatactccatacgccactgtatggcagttggctgttctctggagtaaaatggcgaatactgttgttctcatagcagaacaatccgtcttgataacttcctgcccaaatccgtcctttatggtcttcgagaagactgatgatggctatgtcggggatggatagtttgcgaatggcaaatcctttttgcttttcttttacataaagtccgttcccatctgttcccagccaaatgtttccggccttatcctctaaaatggaggctatatcaccgcattctttatgctgggtatcaataaattcatggaagctttcgtgataataagaaactccttttttgaaatttcctaaccaaatgacgcctgaatcatcacggtagattgtatttattctgttggaagcaagggatgtggaagacataggggtattcaggaggttgacaaggttatcatttacgtagtcataaatgaatactcctttatggtccgttcctatccagacatgtccgttcgagtcatccagtatgctccttaccgcattactttttgtctctattttggaatggagattgatttggttccattccgattttatgtttttcttatagaatatttgttcatcggtatatgaatatagccagatgcctccatgataatcaatgtatatgtgcttttcgataatagagttggagggtaagctgatgttatctacccgtttacatttctttgcgttgttctctagtttcaataaggtcgaattccaaagaagatataggttttcaccatcatcgctgatactcagttccggagtttcttctggaaagttttctattttgaatgttttaagggttttatgagaaaaattgaagtaaaaagcattttggccttgcagtacccataaattgtgtcttttgtcaacatgtactttgtaggtaccatttatctggatgcctattttaaggaggtatgagggaatatcggtaatgaagttgtctttgtctcggtcgtatatacaatatcttgcctcgcttccaatccacaaattgcccaaaccgtcttcctgtaagttccagatgtcgttagacaataaagaatggatgtctttttctttgggttgatacactttaaagctatatccgtcgtatcggttcaatccattggcggtccctatccataaaaagccttcacagtctttcaatatggtttttacgttattgtttgaaagcccgttttctactttcagatggcgaaatacatacggagtttgtcctgctaacggcagataagccagtaacagaataatgagggggaacactaatttgtgtaaatagtttgtaaaagacatactatataatctgaaattgaattctcaaagatagcaatatcttatttaaataaacgtaaatatgttgcattaataggtctgtaatgttgcatcgcggtcgtataagtcttaaacatgccatccgtttgttgtcttgcgtgtcttgaagtgtttttctcatttattattcaacatttatttcatacctttgcagggaaggactggttcctgccaatatgattaaccttctaatactttatcgaaaatgaacagattcatcattttatttttattctctttgggaatattgtcaacatgtgtatttgccgtagaggtgattccactgaatgaaggatggaatttccaccggggttttcaggcacctgcttcggaaatagtgaaggttactttgcctcacacttggaatgcgggcgatggcatgtttggcaatgccgattattataggggattatgcaattacagtcgtaagttgtctgttcctgcccattatcggggcaaacgttttttcttgaaagtgatggctgcacagacggttgccgacatttttatcgaccatcattttgtgatgcaacataagggtggttatacggcatttgtggcagaattgactgatttcctggtcccgggaacagaaagtgtattggaaattcgtgtcagcaatgctcagactatggatgtcgctcccatttgcggcgacttcaatatgtttggtgggttgtatcggggggtggaactgctggtgacggaggatgtctgcatagaacctgcttattatgcctcttcaggtgtattcttcactcagtccgatgtatcggagaaaaaggcccatttgaaaattgaagcactgctttcggcaagggaaactactgtgaccggttgcgaggtggagtttcgactatatgacaaggaaaagttgctttgccgtgttgccagtgcagaggtgggtgaggataaaaaggtgatgatggacatagtgcttgaaaggcctcatttgtgggatggagtgaagaatccctatttatataaaggagtggtgatattgcgtaaggatggaaaagagatagaccgccgcgaagaagagataggtttccgctactttcatgccgatgcggagaaaggtttcttcctgaatggaaagccttatcgcttgaatggcgtgaaccggcatcaggatagggcagaacgcgcttcggcattttatccgcaagaccatgatgaagatttggacttgatgcaggaaatgggatgcaatgccgtgcgtctttgtcactatccgcaagccaaatacatgcatcaacagatggacaagcggggactggtggcatgggctgagattccttttgtcaatgtttatgtgaataatcctgcttatgatgaaaacttgcgcctgcaattgaaggaactgattttacagaactacaatcacccctgcattttgttctgggggctgttcaatgagataaattccggttggctggaccgtccttcgcgtatggcggcagagcttcatgctttggcccgtcagttggacccgagccgtcccactatgggagccagtaatcaggatgacgacttcaacggattcaccgacctgattgctttcaacaagtatttcggctggtatggcgacaacatggatgacatggggcgctggatagaccgcgagcatgcagcacatccggagcggaagatgggcatcagcgagtatggtgccggggcatgcgtattccagcaggaggactcgctgaggcatccggaaccgtgggggcaatggcatcccgaaaactggcagacttattatcatgtggagaattggaaacagcttcaggaacgcgaattcttgtggtgcaacttcatctggtgcatgttcgacttttcggcggcaggccgtagggagggatccattatgggacgcaacgataaggggctggtgacttacgaccggaaaataaagaaagatgccttttacttttataaggcaaactggaatcaagaagataagtttgtatatatcgcaggaaaacgattggtaaacagaacccgcaaaaccgttgatgtgcaagtattcagcaatagcggagctgccaaattgtatatcaatggcaaagcatatgggactgcaaaacctgattccgtaaatgtactggaatggaaaggcattgtattggataccggtgaaaatagaattgaagtcaggaacaaatatggagcggattgttgtgtatggatatgtcctttttaattttcatcaggcgcggaatgtataggagagccacggggaataatgaaccgtgaaatgctgtacagtctgcgcctgatagctttaatatgtgattttctgtaaatccgtattcggtccgtggactaccagtttcccgtccggttggatgtctatggggtcgatgaataccattcgttcgtcaccagtggtttcggtgcgtccatgatagacacagtagaggcggttgtgaatatcgatgagcatacaatgcccggttccggtcacgatgccgccttgctctgtatccttttgcagcaccggattgttggcagcctttgtgaatgggcctaaaggactttgggaggttgcatagcccaccgcataattctttcctccgaagaagtttgcagagtaaagcatgtaatagagattcccgtgtttcaccatatacgaaccttctgtccagcgtctgttgacctcatgtgtagtcaccgaacggttctcccatttcgcttgagggtcgtccatcgttttgggcgggcaaagcaatgctaccggctctccgatgacaccggagaaatccggtttcagctccacgccgtaaatccagctctcctcaatctcgtcaaaccagccctttgttttggcccatgctgagacttcgctctcgacggcatgtttgtagcagcagcgggagtagtagaggtaggtctttccggatgcatcgtcaaagagtatgtttgcgtcgatgataggatagccggggtcgaataccgggcggtcggacaaatctttgaaaggcccggtgggtttatcggctacggctacgccgatacggaagttctcttgctcctgagtggggttttccttccagttggcgctgaaccataagtagtatttgccgtcgcgctcatacacttcgggcgcccagaaacagtcggtggcccatgagtcggatgtgccgccttgatagacgggaccctcatctttccatgtcaccaggtcatcggaggaatatactttgaagccgttctgtactccccccgtcccgtacatatagaatttcccgtcggaagctttcaggaggaacgggtctccgaaggccatgggaagtgggttctgatatactactttcttcttatctccgcatgatgctgacagcagagccaataagaccagtgccaatgtgaaaagggtgtgcttcatcttgttagaatttaaatgttgaagtaacgaaaagtgtttgtatctgcaaagtaaacacaatatagggaaagctgcaaggaaattagatagaatgcaagcttttcattatttttgtgcatcattctaaataattctttgatgggacagccattttcggatatatcgctataccacgagtaccggtcggtgaaggagaaagaacatttggtgtcacagaaaacctgggacgacctcaatctggatgactttttcgaatgggccgaccgtacctcttcttgtgtgggccgacagtacctctacgacttgttgcattacaaccgcctttcggagatttcggaacaggaggaagtgattcgcgaactctctgccgacaaggagttgcgtgcagaaatccggtcggagttgcagaaactggatacgccggatgcttgcgccattgcatcgttgttttccatttcccatcccatatattcccgccgcttttaccgtttgctaagtatattgcagttcgtgccttttgttttgtcagggatggtttatgttacatcttcgctttacgttctggggttattgtgtatatcggtattggtgaacatggtattgcactatcgcagcaaggcacggattcagggctatttcttttccatccctcagttatggctgctgctcaggcaagcggagaggctggcacagattccgttgtgtgtatcggtgcatcgggatatccaaaagactttgcaggcgctgcgtccgttacgaaagcaactttccactttccgtttcagtatcaagctggagagcgacatcgccattcttgcttatttcttcatcgagatggtgaatgtgtttttcctgcgggaggttattccggtttccaaggctttctttctattgcagggcaggcaagaacagattgaagaggttttccgctattttggattggtggatgcgctttgctctgtttccgagcttcgggatgggctgccctattatactcttccggaagcttgtgacgagggtgaaacgcttcatgcagagggcctttatcatccgcttatagagcattgtatccccaatgacattacgctttgtggcagttctgtccttgttaccggctccaatatgtctggtaagacaacctttatccgtgctatcggacttaacctgctttccgcacaagtgttccatacttgtttcgcccgcagttttcgttttcccatggataccgcattgttttctgctatccatctggaggatagtctgatggaaggaaaaagtttctttctgcaggaggtacagattgttcgagagatgctggaggtcggaaagggacgtaggcagcttttcctgctggatgagttgttcaaagggacgaacacggtggaacggatagctatagccaaagctgtgctatctgctttggcacacaagaacagtatcgtgtttgcttccactcacgacgttgaactggcttccttacttgagaacgaatatgaatcgtttcatttttgtgaatgtgttgccgacaataccttgtcttttgattataagctgaaaccgggaccggcgacggaacgtaatgccatccggattatcgagatgtgcggttatccgaaggaagtggtcggggaagcgtatcggctggctaaaaaacatgttttatagttttacttctaattgttccttattccaatcgttactatattgtctgttcaatatcttctggaaggggtaatcttttaagttatccaattagaaggtttatgttcttttctttcatcttttcgatattctcttccgagatattgctgtctgtgatgaaagaatttaccatagatattgaacctaaactggcaaatgcactaattcctatcttggaggaatcagctaccagaatgacttcctcggcggcttttatcatggccgatttaaccatcagatcgctgaggctcggataggtcagactcatgtctggggatattcctgctgtggcaaggaatagtttgttggcatggaaacctttgagtgaatcggctgccatctttcctgtcaatgaaagggtgggtgctttgaattctcctcctgtcacaatgaggttgatgcctggattttcgcccaatataagtgctatgttcagagcattggtaatgacggtcagctctttgtattgtgtaagtagtttggctatttctgtggtagtagaaccggagtcgagaatgatacattcaccttcactgataaacgacgctgctttttgggctatttctcttttttcctcaatatgggtctgattgaaaacctttccggtttttgcaaatgagcccacatccttcaggaaggctccgccgtgttctctttggatataccctaatttttcaagggcttccaggtcttgtctgattgttacatccgttacattgaaaatcctgcttaattcttgaacttttgcatgcccgtcttcgcggataaggtccagaatcttgactcttctttggtttagtgccatatctactttatatattgttgtttctacgataatcctgtatatctttgatcgctataatcctcagtcggaacttttttgccatttcaagtagttgtggcaagcgggccattgtcccatcctggttcagtatttcaatgagagcgccgccgggtgtcaatcctgccattcttgtcaggtcgagtaatgcttctgtatgtccgtcacgtcccaatactccgtcctcatgtccgtaaagggggaaaatgtgtccgggacgtgccagttccgagggctttatattaccggtaaccaaagcacgtatggtagcggagcggtcataggcggaaactcccgttgtgcagccatagcccttcagatcgacggacatggtgaacggcgtgcctaaaagggaagtgttgtcttccgacattgggggcagttggagttctttgcaacgtgaacgcggtagcggtacacaaagaagccctcttccgtgtgtaatcatgaagttaacaatgtcaggagttattttttcaccggatacaataaaatcgccttcgttttctctattttcatcatcgacaactatcactattttcccttgtcgaaccgcttctattccttcgtctacagtattgagcattgtataatcatttaatttttccgcaaaggtagtcagaaaaagtcaaatgaaagtctattcttgctgtttttcttcttttttattctatatattatcttttgcactgtagttcctttctcttttttatttatttgtttcgtttttcgccctggtctaattataaagtatgttaataaacaatggaaaactttcgttttctttcgttttgtggtttttatttgttttccttgcaaggaaatgaaagcaaataagctatgaaaacaaaagaattgactcttcaatcagaaaggaatcgaaaaagattaattgaaattatctataaggcaaaagccggtcatatcggcggagatttgtcttgcctcaatgttcttacggctctttactttgatgtgatgaatgtgaatgcggacagtcctaaagatgatttgcgtgaccgtttcattttgagcaaggggcattgtgtggaggctttgtatgtgacgctggaatccaaagggtttataacagaaggcattttggatacattgggacaatatggctctatcctttcgggacatcccactatcggagttccgggtattgaagtgaataccggagccttgggacatggtttgtctgttggggtaggtatagcgatagctgccaaaatggacaacagggattataaaacctatgtgttgatgggggatggtgaacagggtgaaggttccatctacgaagcagcaatggctgcccggcagtatagattagataatttggtggctataatagaccgtaatcatttgcagattagcggaaatacggaagatgtgatgggaattgatgatatccatgatcgctggacggcattcggctgggaggtaaaggatatgaatggtgacgacatggaagatattatccggactttccgttccattgattatgcaaaccgtcaccctcatttgctggtggctcatacgacaaaagggaaaggagtatctttcatggaaggggtagctaaatggcatcatggggttccgagtaacgaacagtatgaacaggccattcaagaaatatcagaaagaattaaggatttagaatataattgatatgatagcttgcagaaaaagtttcaccgacactttgttgtcattggctcggatggacaaggacatcattgctgtgacgacggatgcccgtggctcggtgacgttaaatgattttgccaaagaattgccgcagcaattcgtggagtgtggtattgcggagcaggatgctgtgggtatttcagccgggttggctcatagcggaaagaaagtgtttgtatgtggtccggcttgtttttatgtggctcgtagcttggaacaggtaaaggtggacttggcttatagccagaacaacgtaaaaatattgggagtaagtggaggagtagcttacggagctttgggggctacccatcatagcttacacgacattgccgtgctgcgtacttttcccggaatgaatatcgtgttaccttgcgatgcccgacagactaaaaaactggttgagcttttggttgattatcccgaaccggtttatgtacgtgtaggtcgtgcagcagttcccgatgtctatgaaaatgatgattttgattttgccataggtaaggccaacatgttgctggacggaacagatctgactattatcggaaccggtgaaaccgtataccacacacgtcaggcggctttgaagttacgcgaatatggtatttcggcccgggtattggatatgtcctctattaaaccttgtgatgaggaagctgttttgaaagccgcttccgaaaccgggcgaatcatcacggttgaggagcatagccagtatggaggtcttggggcgatggtgactgaaatcatatccgagcatcccgtaccggtgaaaatcctgggtatccctgatgagaatgtggtgcatgggaactccctggaaatttttgcccattatggactcgactcatccggtatcgtgaaaactgcccttgacttccttaagtaactccgattcgataaatttgaaatcaattagcctttaataatacctgaaatggaaaacctgataattgcaatagaccaaagcacctcggctaccaaagccatgctattcaatgagaggtgtgaaatgctgaggcgcgtcaatgtcacccatgaacaatattatcccaaatccggatgggtggagcatgatgctgaagaaatttatcggaatgtacagaaaagtatagccgaactgataaaggaggaagtggcagacaatatgtattcgttggccatcaccaatcaacgtgaaacagtggttgtatggaataagcatacgggcaaaccgatatgcaatgctgtggtatggcaatgcatgcgtggtgctgatatctgtaatgagttgaaagccagtgggtacagcgaaatagtacaggcgaaaagcggtttgctattggatccttatttctcagccagtggtgtgaagtggatacttgacaatgtggaaggagcccgtcaggctgctgataacggtgacttattgatgggaaccattgatacgtggctgatttggaaattgactgatggtaaacgccatgtgacagattataccaatgcttccaggactcttttgtttaatattcatacgatgcaatgggacagtgacctgctggagctatttaccatccccgaaactatgatgcctgaattactgccatgtgatgctgtttttggagaaactacggtgggaggattatttaagaatcctattgtcatagccggtgtattgggggattcacacggtgcactggccggtcagatgtgctttgaagaagggctgggcaaggtcacttatggaaccggctcatcagtgatggtgaatattggtgaaaaagctgccgttgctccccgtggattggtcacttccatcggttttgccgcacttggaaaaatattctatgcttttgaaggcaatatccattgtactggtgctaccatcaagtggctagaacagagattgcagatgattagttcgccagacgaagcggaagagttggcggctacagtaaaagacaatggaggtgtgtatgtcgtaccggcttttgccgggttgggagctccttggtggcaaggggatgtaaaggctgccattttagggatgaccttaggtaccgggaaaccgcatgttctcagggcagcacttgaatccatagcctatcaagtgaatgatttggtcagagcgatgaccagtcaggcaggtataaagctgaaagaagtcagagccgatggaggacctacaaaaaataaattcctgatgcagttccaggccgactgcttacgtgtaccgatcaattgttcggatgttgaagaagcttcggccttgggagccgttgtaatgaacggaatggctcgcaagatatggacgagctttgagcaggtgtccgtattacgccggagccgctaccgcatagagccgcaaagtaacctatcacaggtagaaaaatggtgtgaaggctggttgaaagcggtaaaccaattaatcagataaatattttcaaagtataatttaaatacccactatctacaatgaaaaacaaggaaagaatgtgtttcggtataattatcggcactcgtgcttattttaattcagaattggctaaagatgttcgcaaacaattgttgaaaacacttgccgacgaaggctatgattatgtgatcttacctgaagacgctactcctaccggcagtagcagtattgaaacccgcgaagacggattgaagtgtgcggaactgttccgacagaatcgtgaccgcattgacggcattatagtatctctacccaactttggctttgagattggaatcatcaatgctatcagcgtggccgatttgaatgtccccgttttggtacaggcttgtgacgacgagaacgacaaggtggatctggacagccgccgtgatgctttttgcggtaagatttctgtttgtaacaatctgtatcaatatggcataccttttacagataccacgctacacacctattctatatactccgaattactggccaaggatatcaataagtttgctggtatctgtcgtgtagtcaatggcttgcgccatgcacgtatcggtgctatcggtgctcgtccggctggtttccagactgtacgtgcaagtgagaaactgttacagaagagtggcattacagtcgttccggtcgacctttctgaaatactcggtgctgcccgtaagattgaggatacggatgcggagttgctgaagaagcttgaagaaattaagtgctatgcggcagttcccaaggaatatagtgacaagctggtgcttcaggcaaaattcggtgtggctgtagaacgttggatcgaagccaatcagattgatgctgttgctgttcagtgttgggactctttggaacaaaattatggttgtgcagcatgtgtgacaatgagtatgctgggtgaaaaattacttcctgccgcttgtgaggtagatattgccggcgctgtgtccatgtatgctttgacattggcagcgcaaggtcaatcggcattgcttgactggaataacaattttgcagaagaccggaacaaatgtgtatgtacccattgcggtaacttcccgaaatcgtttgtcagaaatgacttgaagcttggtacactgggcgttttgggacgtacgctgggcaaggtcaatacattcggtgccgtatatggtaaagtgaccaaaggtgatttcacattcttccgtatttccacagatgatacaaaaggcgctatcaaggcttatttgggtactggtgaaatcacggatgacccgtatggaatggatggatgcatagctgtcaccaaggtgaataacttgcagactctgatgaagtatatttgtaaaaatggttttgaacatcatgtggctatggttcgcaatgatgtgaaggaaattctgaacgaagccatcgaggactatttgggctggaatctatatgtgcatgaatgaaaagtaaacacacggtaaacaacagaagataaattatgatacttgttgacaactatattttggccattctgtgttgtgtctattgctgcctctgttggggctcttgggcgaatacgcagaagatggtgacctcgaaaagctggagtttcgagcttttctattgggacttggctttcggtttgtttttcacggctctgttgggggctctgacattgggaagcttgggaagtgaaggccgtactttctttgaggacttggcggcaatggactggaacagtatgaagtatgcactgttgggtggtattgtctggaatttcggtaatatctttctgacggcagccatcgctgtggccggtatgtcgatagggtttcccattggcggaggcttagcctggataggcggtataatttttaattatctgctgataactttggccggtgaagtataccccggaaaccaggcattgctttggataggggtagttgttatcattgtagccatctgcatttgcgggaaggcttatggaaagatgtcggcgagtcaggcatccacccctaaaaaaggtatcttattggctattgtggcaggattggccatcatgtttttctatggattggttgtaaaatcactcgatccccagtatgttgcgggtggtacgggaacactgactccctataccggcgtattttgctttgccgccggtgtccttatcactactcccattttcaatacgtttgccatgagtcatccggctcaaggaaacaaggtcacaatgaaggactatctgaaaggtgatacccgtacacacctgatcggtatgttgggcggctttatctggatgagcggtatggtggtcagctttatgggagctggttctgccaatccggctatagcctatgcattgagcaatgccgcaccggtggtagccatgatttggggattctttgtatggaaagagttcaaaggagctcccaaaggaactgtacctatgattgcgactatgtttgtactctttgttgtggggctggtactgattacgctttcaaactgatattttaattcattgttaacccaaaataataataaatgaaaacgattgtaagacaaattaaacagaaaaggttaatggtcttggtgctgttccttttggtaggtatgacatctgtttttgcacagaaacatgtaagtgtatctggcagaatcaccgatgaacttaatgaaccgatgattggtgtaagtgtattggaaaaaggtacgacaaatggtgtcataactgatttggatggtaattataccttgtcggtgaatgagggcgccactatcgtcttttcgtatataggttatgtgacccaggaaaagaaagccgctgcgggtactatgaatatagtactgaaagaagataacaagaccttggatgaagtggttgtagtgggatatggtgtacagaagaaaagctccgtaacgggggccatctcttccgtaaaggctgaagattttgaaaatcgtaccattaccaatgccgagcaggccttgcagggtaagacagccggtgtgcaaattatttctgcatctgcggctcctggttcgaatcccgccattcgtatccgtggatatagcagtaatgccagctcagatcctttgtatgtagtcgatggtctgcgtacgaaagacatcagcaacctcgatccgaacgatattgagagtatggaagtattgaaggatgctgcctctgctgctatctatggcgcccaggccggtaacggtgttgtcttgattaccacccggaaggcaaaaaagggagtccgccgtatttcttatgatttccagttgtcctcccagtctttgggtcgtactcctgatattctgaatgctcaggaatacgtcaattatatgactgaaggcaatcttattcccagagaaacaatagataggtattgggatggaaagacaaatactgattgggtgaaagaaacgtttgaatcatccatgatgcaacgtcacaatgtcaatttccaaggggccaatgataatggttcactgtttgcatcgctttcttatttaagcaacaatggtcccattgtaggcaataaggacgtttttgaccgtattaccggcactgtcaatgcagattataaagtaaaggattggttgaagttcacgacaaacaattcattttcccgttatcatgtacagtctgtaagcgaaggctcagcaaccggttctttgatgctgtctgccattcagcttgaccctcttactccagttacctatacaccggataaactgcccgacactatgattaattatatgaaccaagggcataccttgcttcagaatgccaatggtgattattattctatttccccttatggtgactccaataatatcaatccgtatattatgcgtgaccgtggtacaacgaaaagagatggttttgtgttcagcggctccacttatctggattttactccgattaaagagctggtcatcacttcacgtttgggataccgttatacttacagcaattcctacggctatgttatgcctaacattacctgctctgacctttatcaggactatgtatcggtaagtgcgacaagctccaacaccacgtactggcaatgggaaaactttgccaactataccaagacatttgcagataagcacaatgtaaacgtgatgcttggtatgtcctattcttccaatacttcctttggagtgacgggaggaatcaatggtagccgttccggcgacaaggttgatttgggtattaccaagttggatcccaattatgcctattttgcttttcggaccggtactgccacccgtacggtaagtggtggagagaaacggaggtatgccaatctttcttactttggccgggcatcttatgactatgcaggcaagtattttgcccaattcacccttcgtgcggatgcagccgacttgtctatccttcctttgcagaaacgttggggctatttcccggctgtgtctgtcggctgggtactttccaacgagaaatttatggaaaacctcaagtcaatctctcatttgaagttgcgtgcaagctggggacagaatggtagtatcgccggtttggcagactatatgtatgatgctacgattttgtctggaatcaattatccaatgtccggtgatgtgtcttatgaaacaggttcgttgccatctgcaaccggtaactatgatttgaagtgggaaacttccgaacagatagacttgggtattgacctccggatgctgaatgaccgtttgagcttcggatttgactattatgagaagaaaaccaaagacttgattgtaaccggtattactccttctttgattgtgggtaacactacttcacctatgaatgcgggaaatgtcaagaacagcggatttgagtttgaactctcatggcgtgatcatatcaaagatttcagttatagtgtaaaagctaacatcgctactttgaagaataaagtaacttatcttcatgaaacattggagcgtattgccagtacaacaagtgcaggtatcggcactatgaattattttgaagaaggacatcccatttggtacatgcgcggttatgagtgcacgggtattgatccgcaaacgggtgacccaatattcaaagacaagaatgatgatgacattattggagatgccgaccagacagaaatcggttctgccattcccgactttacttatggtattactttgacagctgcctggaaaggccttgacctgacaatctttggttccggttctcatggcaatgatgtgtttgccggctataaccgtacttcccgtatgaaagcgaataccttgaaggaattctatgacggacggtggactgctgtgggagacaatgcaaaatatgcccgttccaatcccagcaattatgataagtatttaaagagctccaaatttgtattcgacggttcatattttaaaatcaagcagatacagttgggctataacctgcctaagaatttgttgaagcaggtgggtttgagtaaccttcgtttgtattgttctttagacgacttcttcacatttaccaaatatcccggatttgatcctgaatttacgagtacaggcaatgcgatgggtttggatatgggctcttatccgtccagcaagaaagtcgtgctcggtcttaacgtagtattttaatctttaattcaatacgaaatatgaaagcaaaatatattttatcaagtctgttacttgccggctgcactttcttttcctcttgtgaggacaatctggatatttcgcagcatggggtaagcactttcgaaaatttctataaaacggatgccgatgcggaagaagccattatagcctgctatagcaattggaaggacacctatgcgcctgcgttctggctgaagaatcttctttctgacgattgctattcggcaggggaaagctggacggctgccagtgcacagttgctgtcgacttatacgttcgactctgatttttcccatattaaaacgttgtatacgaatctttataaagtgatttatgccgccaacattgttttgcagtatgtaggcgatgattctgaggttaagcttcgtgcacgtgcagaggcaaaggttttccgtgcgatgtcctacatcgaattgatcagtctttggggaactccgccgttggtggaccatccgttgaaagcaaacgaatattcccaggcaaatggtaatacagaggcgctttgggcattggtgaaccaagatttgaccgaagctgtcaacagtggcaatttggaggaaaagacaagcttggacaactttacctatcgtatcaccaaacaatttgcacaagccttgttgggcaaggcatacgtattccagaagaattatggtgctgctgttacagttttggatgaggtaatcaatagcgggaagtacgacctttacagtgattatgagaatatccagactaccaaaggcgaggcgaattgtgaaagtctgtttgaaagtaattatgtttacgacgccaacaatgttaccggcattatgagtaacatgatttgggtatatgtgcattggcgtggagacatgcttgcattcaatgagcctactcaaatctattctcatggcggctggggattttttaatccgacgaaggaaagctacgatgcgtttgtcgaaatgggagatacttatcgcttgaatgcctctatcaagacataccggcaaatggaggatatgggtatctcattgagcaatgccatagcttatatgccggacaatgccggttacttcagctggaaataccgtgtttatgaagcagatgtcatcaactattggtggttgcgttgtcctaacaatacccgtgccatgcgttatgccgaggttctgctgcttgctgctgaagcgagtcttcagtccggaaatgcaagtaaggctgccggatatgtgaataaagtgcgtgaccgtgcccagttgcctgcattgggcagcgtctctatggatgatatcaagaaagagaagcgtctggagctttggatggaaggctgccgttaccaggatttgattcggtggggtgatgctgctacggtacttgccaagagagggcaggaaagaccggctctttacaaagacggccgtgtaagttgggatgaacagaaaaatgcttctgccggcttcaagagcggtaagcatgaactgcttccgttccctgctactgaaatgaatgtcaataagaatatgacccagaacccgggttggtaattaatcaataaaacttagtttatgaataaattaaaatgcttattcctatcaggccttatggctgtgatgccggtttgcatgagcggacagcagacgcccggtgaaaaatcgtcaaaaccgcgtgtcatcattacttgtgacccggaacttgatgacctgaactctttgatacgtttcctgcttttcagtacggatttccgtgtggaaggcttgatttatgccagcagccagttccattggaaaggtgacgggcacggcacgaagtggtatgtgcctggacgtgaatattcccgtaatggcatagactacggacctatggaaagctggcgttgggatccggatgaacgtttcattgacgatgccgtggaagcttacgagaaagtatatcccaatctgaaagtgcacgacccgtcttatccgactcccgaatacctgaagtctaaagtgcgtatcggtaatatcgagttcgacggtgatatttccaaggacactccggggtcggagctgattaaagctgtattgctcgatgattgtacggatccggtattcatcaatgcttggggaggtggcagcaccatcgcccgtgccttgaagtccattcaggatatttatgagcataccgatgcctggaaaggcatccgtgagaagataataggaaaagtggtcctttccctttcgggtgatcaggatgatacgtatgcacggtatatccgacctttctggccggaactcagacaaatggagatgggggggatgacagtcggcctggcttataatgcacagttaagagcctccaaggaaaatcaggttttctactctccggaatggatgcaggagaacatccgcagtaaaggtcctttcggtgaaatgtatcgggtctggggagacggtaagcagatggtgaaaggtgataagttcgatttcttcggtttgtcgggttatacggttgatgaattgaaaaagcaaggctatgtggtttggaccggaatccagccgaaaggctcctatctggctgaaggcgatacttactgtttcctgaatttgataggtaacggcctgcgtggtcacgaagaccccacttatgggggatggtgcggtggaagaaccgtccttcccgattcggtgaagaatcttccgcgcatggagcagatgaagtatagagccgagcactatcctttgcccgacttcacagctccggtaatgaatggattggctgcccgctttaaatggtcggtcactccaaactatgccgacgcaaatcatgagccagtgataaaaggggcgcttgccatgagtgccaagccgggtgagaagctgaaacttaaatacactgtaaccgatccggataaggatgcccttaccattaaatggtggcagtatgtgtcagccggtacatatcggggcaaagtaacggtagatgaccctgcttctgcaaatacagcttttactgttccggctgatgccaaccccggtgataccatccacttgattttggaagctacggataacggtacgccacagatgaaccgctatcaccgcctgattattacagtggcagaatgaacttgaatcaatgaactttaatttgaagaactgaaatgaaaaagattatattggctgcatttatggcagcttgtggactgcaaatgtctgcccagcagaacttgtttgttgcgcaagacctcgagtctgcaatcgtgaataaagacaacacagtgacttttaacttcaaggctcccgatgccaagaaggtacagattgcaggtgactttgccgaaagggcggagggacaacacattggcggtatggtgggcgcaggcctgatagacatgacgaagaatgccgaaggaatctggacctataccaccaaaccgctggactcggaactctacagttatgaattcatggtagacggcgtaccgaccatagaccccaacaatgtttatgtctatcgtgactttgccacaacaagcaatgtattcatcgtagggaatggcaaggctgatttatataaggtcaataaagtgcctcatggaacattggcccaccgttggtatcactctgatggcatgaaaatggatcgccgtatcaacatctacacaccggcgggttatgaacagtccggtaacagaaaatatcctgtgctctacttgttgcatggcatgggcggtgatgaagacgaatggactactttcggacgtgcggcacagattctcgataatctgatagcacaaggcaaggctgaaccgatgattgtcgtgatgcccaatggacatgccgccatggaagctgcaccgggtgaaagcagcctgggttactataagccctaccacatgaagaacggaaccatggacggtgcatttgaaacctatttccccgagattgtgaagttcgtagaaagtaattaccgtgtgcaggcagacaaggcacaccgtgccattgcaggcctttcaatgggtggctttcattctgccaatatttctttgaactatcccgatatgttcgattatgtaggtttgttctctgccgctcttaatgtccagagtgcaggccagcggaatagcccggtttatcaggatatggacaagaagctggctgtccagtttggaaaagctcctaaactctactggctgggtatcggcaaagacgatttcctgtataagaataatgccgcctatcgcgccgatttggataagaagggatataagtatgagtttatggaaactcccggtgggcatgtatggacttgctggcgtatttatctctctgtatttgctcccaagttgttcaaataaatcataacacaccatgaagaaacaactattcagtctgctgttggtcgcaagcgttttgagcgcttgtggaccggcggctccccaactgggtaaagattccgttgaggatgtcattggcgctatgacgctggaagaaaaggcgcgcttggttatcggtaccggaatggcgggtacctcgggtgacagcacggtgattggcactaccaagaagctggttcccggtgctgcgggcaccacttatccgataccccgtttgggaatcccggccattgtgttggcagatggacctgccggcctgcgtatcgatcctgtccgcgaaggcgattctgctacttattattgtacgcatttccctatcggtacattacttgcttctacttggaatcaagatttggtggaggaagtcgggaaatcgataggtaatgaagtgctggaatatggtgcggatgtcttgttggctcctgccttgaatatccatcggaacccgttgtgcgggcgtaattttgaatactattccgaagatccgcttgtatccggcaagatagctgccgcttatgtcagaggggtacagagcaatggagtgggaacttccatcaagcattttgctgtcaacaatcaggaaaccaatcggaatgccaatgatgctcgtgtcactccccgtgccttacgggaaatctatttgaaggggttcgaaattgcagtgaaggaatcggcaccatggacagtaatgtcctcttacaatcatattaatggcacctatgcttctgagaatacagacttgctgtccactttattgcgtgatgagtggaatttcgagggtatggtggtaactgactggtttggagggaaggatgccgtggctcagatgatagcaggtaatgatatgctccaaccgggaagggctaaccagtatgatatgattatcgaaggggtgaaatccggaaaattggatgaatccatactgaatcgtaatgtgaagcgtgttcttgaacttattctccaaactcctcattttaaagaatacaaatattccaataaacctgatttgaaggcgcacgcagcagttacccgccagtcagcgactgaaggaatggttttgttgaagaataataacgaaaccttgccatttgaaaggaaggtcagaaatatagctcttttcgggtgtacttcctatgatttcatagcaggaggtaccggctcaggtaatgtgaatcgtgcctatacagtctcattattggatggtttgaagaatgctggataccagatagatgaagcattgaaggccgattatgaacagtatattgaggccgagaataagaaaaatactcctgactcgtctcagcctttctccagatttataccggtacctcgcccgacagaacttatccctactacaaaggtgttgtcagaacaagttgctaaagcggatgttgcattggttacgctgggacgtacttccggtgaatttgtagaccgtaatgtcagtgattttgaactgagtgaggaagaattgcaactgctgaagtccgtcagccaagctttccatgctgctgggaagaaagtggtggtggtattgaatatcggaggtgtaatcgaaacagcttcttggaaaaaactaccggatgctattttgctggcttggcaggcaggacaggagggtggaaatagtgtgacggatgtgttgagcggtaaggtatctccatcgggtaagttgacaatgactttcccgaacaagttgatggacgttgcttcttcgaccaattttcctatggatgctagggctaatacagatgtgaggaataaggaggacaaaagctcttcagtgaagaatgtagactatacggattatgaagaagatatttttgtcggttatcgctatttcgatagtttcggaaagcaagtgtcttatcctttcggctatggtctttcgtatacaacattcgagtatgtcaatccgtctgtcaaagttgataatggtatatattctgtttctattgatgtgaagaatgttggtaagtttgcagggaaagaggttgttcagctttatgtctccgctcccaataggtttcagatgaacaaaccggaaaaagaacttaaagcttttaccaaaactaaggaattgaggccaggtgagactgttactgccactttgaaactgaacactacggatttggcttcttatgatgaagcttcttcttcatgggtagtggatgctggaaattataagtttttgattggaacctcttccaaggatattaaggctgtacttgatgttgatgtggtatcagttgtggaaaaaacaaatgacatattgaaaccacaagagactgttaatacgataaaacgctgaaggtgagtataatattattcttggttgtgattaggttgatttgtagtgcttaggtaaattaattgtaattgggtaaaattgggaaagaagctgcctcggagttatgaggtagcttcttcttttatttggtaataagataaattaataccctccgtgtcctacttacgatataaatccctatctttgtggcgctttttagctgaaaataagattcaaattaatttagatacaacagaaaatggcacaagaagacgtttttaagaaactcgtatcacactgtaaggaatatggttttgtgttcccttccagcgagatttatgatggactgggagctgtgtatgactatggtcagatgggtgtggaactgaaaaataacatcaagcaatactggtggcagagtatggtgctgctgcacgaaaatattgtcggtatcgactcagcaatctttatgcaccccaccatctggaaagccagcggacacgtagatgctttcaatgaccctttgattgacaaccgcgattccaagaaacgttatcgtgccgatgtgttgatagaggaccagcttgctaagtacgatgacaagataaacaaagaagtggccaaagctgccaagcgttttggtgaggctttcgatgaggctcagttccgcagtaccaacggtcgtgtgctggaacaccaggccaaacgtgatgccttgcatgaacgtttttccaaggctttgaacgataataatctggacgaactccgtcagattatccttgacgaagaaatcgtttgccctatcagtggcacaaagaactggacagaggtacgccagttcaatctgatgttctcaactgaaatgggctctaccgccgatggtgccatgaagatataccttcgcccggaaacggcacaaggtatcttcgtaaattaccttaatgtacagaaaaccggtcgcatgaagattcctttcggtatcgcccagattggtaaggctttccgtaacgaaattgtagcccgccagttcatcttccgtatgcgcgagttcgagcagatggaaatgcagttctttgtgaagccgggtacagagcttgactggttcaagagttggaaggctactcgcctgaaatggcacaaggcgctgggcttcggtgatgaccattaccgttatcacgaccacgacaaactggcccactacgctaatgctgctacagacattgagttcttgatgcctttcggtttcaaggaagtagagggtattcacagccgtacaaatttcgacttgtcccagcatgagaagttctccggcaagaacatcaagtatttcgatccggaaaccaacgaaagctataccccgtatgtcatcgagactagtatcggtgtagaccgcatgttccttagcatcatgtcggcttcctactgtgaagagacgttggatagcggtgaatcccgtgttgtcttgaagttgcctgctgcactggcaccggtgaaactggccgtaatgccgttggtaaagaaagatggtctgcccgaaaaagcgcgcgaaatcattgacaatctgaagttccacttccattgtcagtatgatgagaaagattctattggtaagcgttaccgccgccaggatgccattggtactccgtactgtgtcaccgtggatcatcagactttggaagataactgtgtgacactgcgtaatcgtgacaccatgcagcaagagcgcgtggctatctctgaactgaataatattattgcagaccgtgtaagcatcacatcgttgctgaaaaccttgcaataaagcggttatggaatagaccggtgcgtgaacaaactgaaatagtaaatagtaaaatagtaaaatagtaaatgaaaaagtcccttttgtttttgcctttcttgctgttgctggtgggtgcttttatctcttgtgaagaagtggaagaggctggaaagtatgataattggagagaacgcggcgaggcttttgttgactcgataaaaaggctgactggcgagaattatgtcgccacagcagagcaggccgatgctatggaactcgggaaactgtatgccatacagacgactgcaagcacttctgaaggtgctcagtatgtctattgcaagaagcttgtgaagaatgagacgggtgaacgcccgttgtatacgggttatcattcaaaggtgaatgcttattattatgggacttatgtgaatggcgaagaattcgacggttgctttgacggttatagtgctattgaccgcgatatacctattcctccggtaaaagaacctacggtttttgattcattcgtggattttgaagtttcgggtgtcgttgccggttgggcagctgccttgcagcttatgcggatgggtgagcggtggatgttgtatatcccttatcaaagcggatatggtataaatgattatactgctccttattctacaaatacaatccccggaggctctctgttgacgtttgacttgcaactggttagctttgccgaatgagataaaagagggtgtgtgccgaaacgccccgaatataagaattccccctgctatagatgtctatggcagggggaatctagttaatggagagatgtcttctttagcctgttggtagtgtggcagacgttcggagactggttcgttttatattttcttcttaatggcctttacccagattttgtatccatcctcattcaaatgcagtccgtcgccggtcaactcactgcgtagtacatttgttcccttctctgtaaatagtggaaaaagattgatataggcaatgccttcctctttggcaaacgcctccagacgggagttgatttcaggaaccatatctgtctttccagtcagttttttgtatcggccgaaactttcattgaaagggagtaggctttgtaggtagagttttgtgtcgggagattctttccggatgcgttccaccgtcatgcgaatcatgtctacaatactgtctggtgccaagtcatgggaaatgtcattgactccgataagcaggaacagcttggcgggatgtccgggaagtatctgatgcaggcggtcatagatacccatcacttcatcaccgatgatgccgcgattacgtacattcttcttaccaagacgggcagaccagtcaccgccaccttcagtcaggctattgccaagcatgacgatgtccttgcttgtaatggcaggctcatccataaactgtaggaaacgtttgtagtaatggtctgtataaatacgcggaatggggtagatggaagccgccacagcgttggcaaccaatgaacgcaggcgaactacgctgtgtccgtcttccggatgtacggcgttgataaggagtatgacggaagtgtcattgtccggatcgataatgatggaggtacccgtgtagccggtatgcccataggtattaggaccaaacaaatctccattgttggaggcataggctgtaaaattatcccaaccgagagtgcgtcccagactggcggtagtgcgtggcacagtacgcatggcttttacacccagcggactcaggatgcggcgtccgttccattcacctccgttttgcagggctgcgcagagtatggcaatatcatcagcacaagagaatactcctgcattaccgctgatacctccgttcatgacacgtgccagcgggtcatgaacttgtccgcagagaacttgtccattaggttgcttttcagtgggggcaatgttattcaattgagaattgcgaattgaaaattgagaattggctacgttgttttccttgtgtccttgttttctcgttcctttgtcaactatcgtaatccagttaccatccttatcacgttggcaaggcagatagtcggtatgctccatgccgagtacatcaaataggttttcacgtgcaaagtcacgcaggctctgtccgcttatagtctcgataatgtgctgcaaagtgatgaagttgaggcaactgtattgaaaatcagtctgcggcttgaagtcgcgtttacaagtagcaatatattccataagcccatcaggattgggagaaccgtactgcttttctagctcggctaccggtgcatagggaggaagaccggaagtgtgtgtcatcaaatcggcaatgcggattacctttttctctttgccgtcttcgctttcccaattcttgaaatggggtatgtagaggctgacggggtccagcatacggagcttgccgcgttctgccagtatcatcgtacatacggcggtcgacatggatttgctgcaagatgccatatcaaagatagtattggcagtcataggctccacattgggataaatacgcttgttgccgtaagctttcagataggccatcttgccgttacgtactacagcaagtacggcaccgggaatatccttgttggagatggctgtttcaatcgcttcgtcagcatacatcaacttgcgtgagtccattcccacttgttcaggggctacgcgttgcaagggttgcgcggtggcagcttgcagacaaagagaaaagagaaaaaaatatattgctttcataataaaggaatttaagagtgagtaatagctaaatccggtacgcatccactgcctttttcaccgaaccgtgcatcaacagcagcgccttggctttgccatagtccagtccgagttcctctacaatcatacgggtaccacggtccacaagctttttgttactgagctgcatattcaccattttgttgcctttcacgcgtcccaactgtatcatgacggaagtagtaatcatattcagtatcattttctgtcctgttcccgatttcatgcgtgagcttcccgtcacatattcaggccctacaatcatttcgatggctacatctgcctctgctgccattggagagtccgggttgctggtgatacagccggtcagtatgccgtgttcgcgtgcctcgtgcatggcaccaatcacgtagggggtggtaccggatgcagcaataccgatgaccgtatccttatctgtaatattgcgttccgtcaactcttcccaaccgcggtgaatgtcatcttcggcattctctaccggatttctcaatgcagtgtcaccaccggcaatcaagccgataaccagcgtggggggcataccgaaagtcggtggaatttccgaagcgtcgagtacgcccagacgtccactggtacccgcacccatgtagaagatgcgtccgccttgtttcatgcggggcacaatctgggttaccaacttttctatttgagggattgccctctgtacggcaagcgccactttctggtcttcggtattgatgtcttccagaatttcacggactgatttcttttccaagtcattgtagagcgatggttgctctgagatttttacgaacataaggctatttactatttgacgatttactatttacgatttgtcactttcagttgtgatatttgatgagtctttccatggggctcttgatgattgcgcccagttggatacccatttctttggcagcttctgccagaacttccttgtaatagaaggctacggaaccgatgaaatgtactttttgatgctgatagtcttcatattgcatgacattgcgtttaaggaatgccttaaagctgttcagtaccagagcgcgtacacaaggttcacccagattctgtgcaagaaatggtgacaagcttgccaggaaacggttggggaaaggtttacggtagacacggtcgatgatatcagcaggtgtcaggtcgaactgtttgaggaatttctctttcagctcgggtgtcatctgatttttcaagatatcgcctaccaacagtttgcccaagcaggctccgctgccttcgtctcccaagatgaatcccagaggagatacattggtgacaatgctttttccgtcataataacatgagttggagccggtccccatgatgcaggcaatgcctgagtcatgtccgcagaggccacgtgcggcagccagcatatcggtattgacttccacttcatttttcacactgaggtgtttggttatggcacggtgcaccatacttatcttgtcgggaaatccgcatcctgcaccataaaagtatacggcatccagctcacttgtcttcagctgaggtaatagcgctgttgctatttcattactgatttcctcttccgactgaaagaaagggttcgtccctttcgtgaatatctgttggagaagtactccattctctacaacacaccaatcggtctttgtagagccactgtctgctattagaatcatataaataatgtttaatgattagggattaggggctagtgattaaggattagtgattaatggtaggtgatactgtttcttaattataggcaacgtattaatcactaatccttaatcactaacccctaatccttatattttgatatatatttttcgtttgtacaactggtagccgatacaccagttaatggcgataaacagcagggcaaaggcaagggaaccggcggtttcaccgaaaacgggcatgaggactatattgtataagaatccgtgtatgctgatgctgctgtttccccacgggaaactgatactaccgaaaagtatgctaagtacgccgcccaatacatacatgaacagcggattcacaccgaatgcctcgaaaaacatgctccacttcttatagcctttcacatcaataatccagataagcaatgccagaaaactggatgccagtccgcaagtgacgagtacgtaggtaggagaccatattttcttgttgatggggcagccgtagcttagcaggaaaccggagaaagtaaggataacacctaccagaaacagtgtgataagctgcgaattgagaaatgaggcacggtcttccgacttgttgccatccagcatcagccgccctacacagaagcccagcaacacatgtgcaatggcaggaatggtgcttaacaaaccttcgggatctatgccgttatccttgtacatgtgtgcaggggtcaggatggcacggtctaccacggaaagaatgtttgtttcattataggcgaaaccgttgccgcacatcaacagtatgaagtagcctgtcaataggccggctatcagataaggtatatgtttatgcttcatggttagtgcaatgatggaggctgctccgtagcaaagggccagccgttgcatgacacccagaatacggatacggtcgaatgtccagacggaagcccatagcttctctccgaaactgaggtcgtccggagcggaggcccagtaatagcagaaacgcgagaaccagccgatagccatgcctataaggaaaatgacgatggtgcgtttcagtatcttcatgccggcggcgtggctgaactcgaagttgtatttcttcagggaaatgtatgtggaaattcccatgataaacatgaagaagggaaagacgaggtcggtgggggtcagaccgttccactctgcatgccgcaagggggcatagatatgtccccacgaaccggggttgtttaccataatcatacctgcgatggtgacaccacggagaatgtcgagtgcaaggatgcgtttacttacttttgtactgttcattgtaatatttgtgtgttaagttaattatcaatcctaattatcagctgcctttgtacattcgtctaccagataggcaatggatacataggggatacctgagtttgttgtcaatccgatttcacaagtacggctgttagagtagcctatattcactccggacgcttctatttgcgggcggagtttgcgtagggcgtacgagttcagctcaggataggtgaatccccggtctccggcaaaaccgcagcaacctacttcttccggcacgatgactttactggagcaaaggcgtgcaagggctataatggtatctgccagtcccattttccgcatggagcaggtgatgtggattgctacggggcggttaataggtgtgaaaattagcttctcacgtaagaatgtatagatgaattctgcaggttcatacagtttcatcttcttgatacattcgcgcatgcggtgcagacaagggctttggtcacagaggacggggtatttgccttgttcgctggcttcccaaagtgcggcctccagttcggctgtcttgcgatcggcaatgtccagcatccctttactttcccaaatggtgccacagcaaagcttgtccatatctttcgggaagatgatttcgtaaccggctttttgcaacaaggacaccattttatttaccaatggctgctctacgggagacttctttgccagacccatagtctggttgatgcagctggggaagtagacgactttgtagttacgagttacagagctacgagctacaagtgctgcgctattatgctgcatagtgcttgtagcttgtaactccgtagcttgtaactgataacttttcggcatagccggcgtccatagaggtatgcctaatgcattgtgcagccccttggtaatgccgctcatcgcctttgtccctaatagtgaatgtccgaagttggctaaggacaatacgggacgcagtgcactcttgacaccagcgaaatgattggcgacaaagtctccggctttgtatcccagactgcctttgggtaatgcttcctggcggattatatgggtaaggtcgcccgtattgatacccatcgggcacgacatggagcagaggccgtctccggcacaagtctggttgccgggatagcggtattgtttttcgagcagtgcaaggcgtgtcgggtcctcaccgctttgtttcagccgggatatttcgcgctgcaacacgatacgctggcgcgaggaaagggtaaagccgcaggagagacagttgacttcgcagaaaccgcactcgatgcatttgtcagctacgagtgacgtagcttgtctcttgtcactcatcactaataaaggcagcggcttgaagttcttgatatggcattgcgggtcatcattgaaaatgacaccggggtttagcaatccttgtgggtcaaacagctctttgacggctttcatggctttgtaggcgtcatctccccattcatggcggacaaagggagccatattccggcccgtgccatgctcggctttcagggaaccgtcatatttatctactaccaaggtcttgatgtcattcatcaagtcttcgtagcgtttcacttccgcttgggtactgaaggactggttgatgatgaagtggtagttgccttcgagagcatggccgtagatgcaggcgtcattatatccgtggcgggctatgagctgttgcagttctgccgttgcctccggaaggtcttcaatgtggaaggcgatgtcttcgatgaggcaagtggttcccggttggcgcgtacctcccacagaggggaagatgccggaacggatggcccagtatttagaatattcctccggacggtcggtgaagcgtaccggaatataggtggtgaaggcttgcaggcaagcttcaatggcagatatgttctgttgcagttcttccggggtacgggctttggtttcggtcagcactgctgtcaacccggtttcgtcgccgggctccacgccggggagggcagaggaggcaacttcgcctttgtattttaggaatacggggtcgttgacggaagaaaggctcttatagtctagcatttcagccccttttactgtccattcgccggtttcgtcgaccagcttcttcatggctaccacagcgcggctcgcttctttgatggtcttgaagtagagcatagcgctggccttgtagggataatcatattcagtcttcatcgtcacttccgaaaggaacgccagtgtaccttcggaacctaccatgaggtgggcaatgatttcgaatgggtcgtcgaaacggacgaagggcaacagattgagcccggttacatttttgatggaatatttgtaacggatgcgttcggccagtttttcgttggtacgtatttcatcgcgcagttcgcagatgcggcgaatgaagtcacggtgactcacttcgaaggaggcgcggctgacgggatttccggtatccagcagggtaccatccatcaggataatacgggcggaaacaagcaccttgtcgctattggcgtgcgtaccgcagttcatgccggaagcattgttcatgacaataccgcctaccatggcgcttttcaccgaggcgggatccggtgcaaacttacggccgtagggagccaacagttcgttcacacgttgtccgatgatgcccggttggagggttatctgttcgtagtcggcggatatgctgtatttttcccaattcttgccggctacgatgaggatggagtcgctaatggcttgacccgacaaactggtccctgccgctcggaaggtgacgggcagcccgtggcggctcgccagtttcaacagttgtgaaacttcatcttcgtctttcgaacggattacaatctggggaatcagtcggtaaaaaccggcatccgtaccccaagccagccggcgaagttcgtcggtgtaaatcctttcctgcggaatgaattgttttgcttcctgcaggaaagccatgtaactatgctctttcatgttcactttttttattgcatcacttcgcttcaaagtgctctgtaaacgtgtcttacgagggggtacattcagtcgtatactgaatatatttaagtatacgactgaatgtggttctgtatacgactgaaatagtctccgtatcaggctcttttcccttccttatttatctgtaaatttatttatataaataatactttttcgacaacttacggaagtcttcggcatctttataccagtagtcgcgtatgtcctcccaacggttccgtttcgagaagcgctcgcgtatctgccgcgaaccgcttactttgtcgaacatgttgaaacgtcccttgtcggcatggtcaaacacggcacggtcaggatagagggcggcgacttcctgcatgaccaggaattgcaggtcgctcaacggtgctttgccgaaatccatgatgtgcacttgcacaccttgcagcaactcgcctttgcctacactatagaacggcttcaggtacatcggtctgaagatgacccccggtacgttcagacggttcaggtttccggccagcttttccgcttccatccatggtgcggcaaacatctggaacggaatggtataccccacgccgatagacatatatcccagttcgcccagaatgccgctgacggggtagaagaatgcagaatgaggatgtggaatgtgtggagaggagggaacccattgcagtccggtttgggtataatccatcttgcgtttccagcctttcatcttcactatgtggagattacattgttccccatccttcaacatcttctcgccattgagcatcagtgccagctcaccgcaagtgagggcgtaaaggtacggaattttaaactggcttacaaaagaaatgcaatcatcttcaaccaagttgccttcaatcttcaatccgcctacgggattgggccggtccagcacaatgaattccttgccgttttcggcagcggcttccatggccagtcccatggtgctgatgtaggtaaaggaacggcaaccgatgtcttggatatcatacactaatacatccacatctttcagcatgtccggcgtggccttgcgggtctttccgtaaagcgaatagacgggcagtccggtagtcgcgtctttgatgtccgtcacatggtcgcctgcgtgcacatcgccgcgcacgccgtgttcggggccgtagagtgccacaaggttcacgttgggcgcctcgtgcaggatgtcaatggtggacctcatccggttgtccacccccgtcgggttggtaatcaatcctacacgcttaccttccaggcatcggaaattctgttctttcagtacctcgataccggtctttattctgatcttctgtgcttgcatcgcacctccgcaaaggaggcagagcaaggatataataatagtcctcttcataaccaatcactaaatattactcacaaaacattaatcattaaccattaatcatttttttccatattccgggtctatccttctgtctgcaaaaatggtgacaacaaccgtggcgaaacagcatatcattaccaaccagaagaagtccgtatatccgatagcctcctggatatatcccgcaaacatacctggtatcatcatgcttagtgccatgaatgcggtacagatggcatagtgggatgttttgaattcaccttcggagaagtacatcatgtagagcatgtaggccgtgaaaccgaagccgtagccaaattgctcgatggcgatggcggttgagatagcaaacagattgtcgggctgggcaatggcaagatagacaaacgtcaggcatggcagagtcatgcatcctgccatccaccagatggattttttcaagccaatgcgtgatgcgaacaatcctccgaggataccgcccagggtgaggaatatgactccgatggtgccgtatacgatacctacttctgctgtcgatagttccagacctcccgattctttggaggcaaccaggaaaggcatacacattttgatgaggaatgcttcaggcaggcggtacagcaacatgaacacgatggccagcaatgcgcccggtttggtaaaataggtggcgaatgttcgtccgaattctctgaatatagctcctgcagtggcggcatcggcagccagtgttgacttatctgaggtgggtttggggactgcaaagaggtgatagaacgtcaccaggctgaacagaacggctgtaaccagcatcgtgatggtccatgacagcggaatgttttcggttctcagttcgatggcgccggcaatggctacgagcacgccttgtccgaagatagaggcgagccggtaaaacgtgcttcggatgccaacgaaggctgcctggtcactctgtttcagtgccagcatgtagaagccgtcggcggcaatgtcgtgtgtggcagaggcaaaagccgtgatgatgaacagcatcagcgtgatgctgaacatgctgatgggggttgttccggccgccatagtcgcctcgtccggccgtggaatggacagcgtcagcaggatgaatgccacagacatcagaatctgcatggaaagggtccaccatcttttggtcttgatgatgtcgacaaacgggctccagaagggtttgatagtccatggcagatagagcaggcttgtgaacaaggccatttctccgttcggtacgcccattttggtaaacatcatcacggagatgttgtttacgataaaatatggaatgccttgtgcaaagtacaaggtgggtacccatgcccatggcgatatgttttttgtatggttcatgatattgatttattgtgttctattcgattattcatacagcttgtcaatgctggcacctatatagtagtgcagcagtattgcatcatacttatacccttgttcgcccatcacggctgcacctatttggcaaagtcccacaccatgcccccaaccggcgccggtgaggatgaagcgtccgggaatgccttcggcggacaactcctctttgtctaccacgaaggcagagctgtagaggtgtgaagtggagagcgtgcggcggatttccagttccttgccgatggtgagtgtgcgtttggttcccacaatcttcagtttccagaggcgtccgctggttccgcgggctatggggataaggtcgatgatttgtccgtagtcaatgcctgaacgtttcagaatgagggctgaaagctcttcctgggtatattccactttccagcgatagaagtccgtagtctcctggtcatagttattgagtacctgtgagaggattttcttgtcggtggtgttgcagaatgcttcgggggaggtacgaatccagcggtccgcttcgacttcctgcgtcaaatcgggcagtgtggcgtgcgttttgctgtctcgttgttgggcaagataggggtatttgatgtcttcccagcagtattggaattcctcgaaagcaccgccgcagcatttggagaaacgggcgtcgcaaatcttaccatcagatgtcagtacctggccgcgggtagcggagatggcttgtttcacaatatcggtagaggcacgtgtaatgccctggtagcgttgacaatggtcgtcggcgcatacatcgaaacgtgtgtggtcttctcggtcgtaccagcgaatcagctcttcgtcggtctgcgtaaaggccgagtagttagcttgggcttcggtgatttccttattcttttgtatttgtgccagtagccagcttcgggagatgacagcgtgtgccttgagcagctccagagaagcggtggcactcatctcggaggagatgacgctggtcagataatcttctacatggatgacgttgatgccggtgagctttccattctcaacgatgattttgagagcacccagaaaacgctggtcttccttgcgctcccaatggaaattgatgccgatggtaacgtccaatagttcgaaggcatcggtctgctcgtgttgcggttcaaacagcagttcgtcataccggcgtccattccagagaatcttgccttcgtcgtaggtcactacctgcttgccgctgacttccgttccgtccatgcgatacggattcagcaaaacgaattctatctgcggttcaaacagaatgcctacttgtactttgggctctttcataatggtatttctttaaaattagagttcttggatttcagaagtcatattttttccctgatacgctgccgtaccttgtggaaatctgtggcagagaggcatacttcacttaatatctgcgccacgtcttccgcagtgattttcaagaaatccttttctacgggggtgataaagacacctcccaagtcgacggatgccgggctgctcaacagattggcttctccttcggcagtatagcaggcggggcggtgtttctcgcgcgggaagacaaagaccacccaacggtcggcctcgtataggaccagtacgttcatcatcggctcgtcttcttcgggtttcacgtccagagaacggtaaatgatgtcgaacaagtctgccgcgtcctctttggaggtggattcaatcacaagtgtggcacggggagcgtcgtcaagataccacagtgctgctttcctataatcggctattttcccggcagtctgtccgcgccagtccttttcaataggcatgaaccctttgtttcctgcctggaaatgagcatggtcgggggcggaagcaccacatttgggaccgttgtagaagatggtgtaatccgtcagcgcctcggccagctccagcatgtcggtgaagcgggtggctatgcgttgaggggtatgtgccagttccggtactgtcaggtggcgggggaagatggggaacggattcaccagaatattgtagtgtcctccgaacgggatacctttctgtaccggcggcaaattggccgggcacagaaagcatttccgttccaggatggacttggcatccactttggcaccggaggaaacgatgcgtgcggggttgaactgtaccttataaagtatcccgtttacattcagctctttcacccgcacaccggagagggcggcatagttgttgcgtgccgtctcccaggatgccaattgtccagtcagaagatggtgtatcgtttgattcatatcacttgtttttgttcatcgctatgcgtgcctgaagttcccaggtacggatgcggtctttgtagaggttgtgtccgttcattttcacgatgtccagtgaggcatcggagttgtcgtcccaacggcggcagaggtagaccacgtcgtacacacgtcctatctggtattggcgggagaagttcagtcccagtgcatagtcttcgccatagctggtattgggtactttcacttcgcgcagcaccggggtatagaaggcgcgcggggcacccagaccgttgatgcggagggcgttgttgcgtccgtttgccggagtccattccttgtggtcgatgatgcccggagcaatcatgttcatgttgaagtccgtcatcatataggtgcctactaccatggcgcagttctgctcgtagaaggcgcggaccatgatggcgagtgtattttcgtctttgtatacgtcatcgctgtccagctgcacggcaaacttgccgcacttggggtggtgtacccccatattccagcaaccgccgatgccgaggtcggtacgttcggggatgatatggatgacgcgttcgtcatccttgaattcatcgatggcctccgtagtgccgtctgtggaatggttgtcgatgatgataagattatatttaaagtctgtcttctgcatcaatacagatttgatggcgtcacggatggtacggatacggttgcgtaccggaatgatgacggaggcctcatattcgaagttaccggcagagaactcaatcttcttgaactccggtgccagatatcccccgatttctttcagatgttcggtacatgcctgctccatctcaatctggcggtcacggtttttggggtctacatagtcgaaaatcttttcgccgctcttgcgggtatcgttttccacctcgctgtataagtattcgttgatatgtaccaagtctgaatgttggctcaatttcaagcgcaggtcgtaaagtccggcgaagttgtagtcagacttcatgtgtccggcggcttcctttagtttttcggtgttgaaaaggagcagggagccaaagttgaagtcatccctcaaggaaccgaattggtagtcgattaccggagcgttgctctgcttgccgtctgctatttggtagtggtcggcatataccataccggcgcttgaatcttcaaggatgtgtatcatacgttccagtgcaaacatacccatttcgagcgtagtctctttggtataaagcaatgtgtattctcctttggctgcattagcaatagctttgagggttgcactgctgtagggcatgtcaacaaacaatatttcgcagtccgggagcgattccagagtggcatcggtcgtgattaaccggatttcttctataagtcctgtcgcctgtaggctattcactgttttttctacttgttcttttcctgcgtagggaagaaagcaactgattttattcatgatatatcttttaatttttaattctcaatttttaattctcagaagtcccacttccccgctggttgccgtgaatagaacttcgtggccgttcaacggaactacggtactgatgagtgaatttcctattttatgtttccacagtactttgcctgtttttccttccagtgcgaagataagtccttctttggtactgccaaacattaccccctctttttccacttgcatggagggggcatgctcataaccgaaacctacattggttgcccacaactcccgcggagtatctccttgagctgcatagcaaacaatgctgtcgttcatcgttttgctatagatacgttcaccgtcttcggaaagtccgatggtctcgcgcaccatggactggaaggtgcgccacacggtattgcccgtatggatgtctatggcggtcatggcgcgttgcgggtcggtaatgaatactttgccgtcggtggctaccggccatacggcggctggagagaagtgcatacgggtcagtccgcccgtccatttccatagttcatgcccgtttgccttgctcagggcatacagtgtattgtcccatgcgccgaagataactttgtcttccgtcaccaacggcttggtctcgatgtagcccttcacgctggtgtaggcccagattacttttcccgtatggatgtctatggcacggaaagtggcgtcactggcaccgatgtatgctctgccgtctgcgatggtcacggctccgagcaccggttcggcggcttctaccgtccagagcaggctgccgtctttggcgttcaatccgtagatgcgacggtcagcagacccgaatacaacgataccctcgcttacggccggagtaccgacaatgcgcttgccggattcaaagctccatagctttttaccgtttttcagggcgtaggctgtcagctgtcccatatcgtctcctacgaacactttatctttttctacggcgggagagcagtaaatgcctgcgcccgtctgcaccatccattgctcctttacttgcggatactccttgttgaccgagaagtcaggatatttctctgcctttccgttgcggtcgtaatactgtccggtcagcgagaatgctgtccactgcttcttgggctcgccgatacgttgcgtgtatacccggatggaatccccggttacttcatagatgccgtaacccggtttcccttctttgtcgcacaggttgctgcgcatcagtacgcccggaatgccgtcgtaacgtaaatcccggttgctgtggtagtgtccgccgataaacaagcgcacgttgtaggggcggacggcatccgtcacctcataccaattgtccacatcaccttccattagcgggtagtgggtgacaagtatcaccggtttgtctttgccgtttttatccatttcttccgtcatccaacggatatcttgcggcactacatgcccgtaggccatacgcatcagcggaccggagttgaagccgaggaaaaggaatcccttatgctcgaactcgaagcgttcgccgccaaagatttctccgaaagcggtacagccggagtcgctccatttcgtttcatggttgcctaggactacgtggtaggggaccttcagcaagtcaaggcacgatttcactttttccatggtagtacggtcgccttcttcggtcaggtcgcccgtcaccaggacaaagtcgatactgtcggtggcattaatctgtgccacggaacgcagcaggtcctctgtgggattcggattgttcggggtcagatgaatgtccgtcagttgggcaaaacggaatgtcccttgctgtgcctgcatccccagggggagcaggcaagccatcaggacgattattaacagtcttctgttcatagatgatgattggttgatattacttgttgtcattgaagaatgtcagtacagcattcatgaatgcctctctttcagaatcagtacgtatggattcaaaagggaatcccaatacaacagtcttgtagtcgccttggtaggccacaccggcactcaggttgttttcagaataccgcatcacggtgtgtgcatctttggttgccggttcaatggcgtccggtgattccaccacatacgaatcggcattcagctcattgtgataggtatagtttcctgaaagggcggggaacggagaagctacgcttttcaccttacccattgtagccgcttgtcccacacgccacttatatttcagtacttccatcgcaaatttcttgtcggcttcgtcggcggttgcaaggcggttgtcccataaatccgttcctacaaaagcgcccgaaacaaagatatttccaccttgcttacaataagccgcaatagcctcctgcatcggtttgctgaaagtcttgaactccaacggttttacgcctccccgtcccatcttggtctggcattgcttcccaagtatcaagtccacatacctatactccctcatatccaccggaatattcttctctccctttcctacgggggagagactttcattactaaccgatacaaacgaatatcccgctttcaggatagcggcaccatgtatggcaggataatcgaacgtatttcctgcgatgacttgggtctcgtaatttccataactgtcgccgaaaccggaggcgtcgtcgtccatccagggaatggaacggcggtattccttcatcttgccaatgtagctgatgtcatggatataggggaccccgtggtcctgctcatccagaaatccggcaaggagggtgtcggcgggggcgggggccgtaaagtcggcaggggcactgatgcggtcgaatccgtttatcaccaatacggtacctttggaattgaacgcccgtccggcggaaagaatttcggaagggaaactctcgccgcccttgttgacagcggtaaccttgtagctgcataccatgccggcgaggagcgtggttcggtaactgttgccgtccaccaatactccgttgtcgaaatccccgtcgccgatacgggtataaacaatgtatttctctgctacggcagttggttccaacgcatccgctacgggttgccaggtcagttccacttcgttctcgctggtcatgcgcaaggtcatgtggtctaccggtaacggttgcactacataatccatgttgtattgtgagcagaggaactgaagcatacctttgtagatggcgcggcttacggtgaaacggaaacgcgggtccagtccgtagcgcatgtctgcaaagttttgatgggaaagtagttcgagtagcatggtaggtacgcggggtacacgggcctcatagtaggattggttccatttgccccggcgtgtccattggggttcgtagagggtacgcacgtcacgcacgatgttggactgaatcaagtctgtcaggtcgtggctcaagtagcgggatgctccgttggcgaatttctcattgtaggcgttggtatagtagatgccgagtgtcccgatgatggaatcgttcagtgtagttcctgcatcggagtggaaggcaaaggccatgttgacagggatgttcagccctttttccgtcgggttcacggcagagcctccggaaaggtagttcacccagataccacggcatttatagtcgtcggtatagtcattcttgccgttgctttctgaatatacgctgtccggtatgcctgcccattgcagccagtagcgggcggcttcgcagaaacggggataaccgctgacttctccccgagctatgtttcccatgccgccgcctatcttcacggcgtcggcagtgatgattcttcctactttggaggaaaggttgttcagaacgactttgcattcattgttccggccggcattgaagccgaaggtgccgaggtaaatccaggtgccgcctcccatttgctggtttaccttgaactgcgtggtgccgcctttgtgatagacggtgtaaagggcatcgtccgcgctgtttggcaaggtttggtaagagacgtatacggcgtattgtccggtcgaagggatttcgggaatccattcggcggtgcttgcgtttcctttcttgatggtttctatggcgcggtaggtgccttccttgaaaggattctcaaagtctatgtattgggggcgcaggtgggcgaagccttgtccttctccctgactccagagcttgtcaccggaattttctgtatagacggaacggccggtcaggcaaccgtcattgtctacgatgacttctgccgtctggcaatcgcgttcgcggggaagcagcacattggcaccggcattttccaacatcggtacgaggaagggcaatacgtagctctgggtgtagaggtcttccactgtctggaagatacgcgcacgctgccattcccagcggtcgagttttgattcgtagtaccagccgtggctttgccatagggcgatatgccggttatgcaagccgttggtgggggtgtagggggaggaaacttcggtaaccagaggcttggaagcgacggggctgaatgtcttcgtctttttgtcttttttactgcgcagggcttggggaaccagttcttcgatactgcgcttgttggtacggatttgcagcttgtatttggcaaactccaccggcagcagggcgcttacgccttggtagatttcggccacattgtcctcacggaaaggaatataggcacagttcatgttggcaaacagttgcagtgtatttccttccacagccactgagtcgatgctgatacgtcctacggaaacttcttttcgtgcggtggtatccaagaatttcccgattgcctggcggacatccgtcggaagtccttgcgcgcctcccgcgtgggggaagagggaggcggcaagcagactaagtaaaaactgacgtcttacattcatagatgatgtattaagttaattgttctttttatctttcttaatcaatagacagagaccgatgaaagtgaacagtgcattgaaaatcagcaattcgtagctgaattgataacctccgaaccagacttcggaattcttctgcagaatgaagcagagaaccggggaggcgatggcaactaacgggatgtacttgtcacgcacttgttgtttcatgaaaatgccgaaagcaaacagacccagtataggaccgtaggtatagcttgccagaatatatacagcgtcgatgacactggtgttgttgagaagattgaatacgaaaatggtgattcccatgacaaccgccatgccgatgtgcactttcttgcgcatcttcacaaccgtctcttccgacttgcctttcgttcccagaatgtctacggtgaaggaagtggtcagcgcggtgagtgccgagcctgcggctgaataggcagaagaaatcaggccgatgatgaacagtatgcccacaatggcagggaaatagttgccggtggcaatcagcgggaacagttcgtcactcttctccaccgcaatctgctggttggcggcaaagatgtagagcagcacgcccagcatcaggaaaagcaggatgacgaagaactgcgaaatgacactggtaatcatgttcttctgtgagtccttgaagttcttgcagctcaggttgcgctgcatcatgtcctgatccagcccggtcatggcaatcatggtgaaggcaccggcgaggaactgcttgaagaagtactgcttgctgttcacatcgtcgaagaagaagatgcgggacatgtcactgtcggcaatggtgcttaccataccggtaaatgacagattgaggtcggaagcgatataccagatgcagagtacgaccgacaccaccaagcagaatgtcttcagagagtctgtccagataagagactttacgccaccctggaaagtgtacaaccagaccagtgccaccgtgatggccacgttcagtaggaaaggcagtccgaaaggttcgaataccagcagttgcaacgtcaggcatacgaggaacagacggacagcggcaccgagcattttggagatgaagaagaaccaggcacccgtgcggtaggaagacatgccgaaacggttctccagatattcgtagatggataccaggttcattttgtagaatagcggtaccagcagataggctatgatgagctgtccggcaatgaagcccaacaccatttgcagatagccgaagctgctggcggcaaccatgccgggtacggatacataggtcacacctgaaatggcggaaccgaccatggcgaacgccacgacataccaggatgacttgcggttacccacaaagaagccggcgttgtctgccttccttcctgcaatataggataccgtgaacagtatcgcgaagtaggcggctatggtgatgattacggatagtggagtcataatgtttatttacaatttgttcatttacaatttacaatttgccatgcggcgtttctttagtataaactgttgtaccttcccatttacttttgaattgtaccttctctgaaattgtacattgtaaatagtgaattgtacatgtctttattcttcgtagagcaggtagggcttgcgctgtaccttgaatttctctacgtcgtctttccatcttgccttgatttcttcggcgcttttcccttcctttatcattttgcgcacgtagtcggtgcctatcaacagctcgaagaaggaacggaagaagtggtcgtccatgttcagattccggtaagcgtctatcacgtaactcaggtcaataccgcgtttccagatttcctcgtcgctcatgttgctcaggttcacgccgtggcaaagcttgcccaactggggcggattcttggctccgggaacactgcgcggggtgaagctgtagctgtagcccgtcatgttgggatgcccgtagacctggaaggggaggtcggttcctcttcccagactgaccggagtggcctcgaaatagcaggtcgaggggtacagatagatggacttcatgttcggcagattgggggacgggggaatcggcagcttgtatagggtccggtgcgtatagttcttgcagggaatgacggtcaggtcgcaagtgcgtgacgccggcaaccagcgttcgccgtttaccatcaggcccagttcgcccagcgtcatgccgtgcaccacgggaatcggcagccaacctacaccggatttatatttcatgtccagtatcgggccgtccacgtagtgtccgttcggattggggcggtccagtatcagcaccttgcggttgtattctgcacaagcgtccatcagccggcacatagaggcataataagtatagaatcttaggcctacatcctggatgtctaccacaaggatatcaaacttgcgcatggatgcttcgcttggttttccggatttcccgtcgtacagcgagaggataggtactccggtcttcttgtctaccgagctggacacgtgttcgcctgcgtcggcatctcctctgaaaccgtgttcaggggagaaaatggctaccacattgaacttgttttccagcagaatatccaacagatgcttgtctcctatcattcctgtatgattggagaatatggcaattcgtttatcttttaggattggaaaatactcggaagtctgttcatcacctaaaataactcgttcttcttgtgcccggcacagtaaagaactacatagcacaaaggctaaaagcagcagtttcttcataatagtattattaaggaggacgttgtttgcaacaaagatacgttttattttaatatcaaaaacacttatttgggtatttttagtattatcaatcataatttgcaaatagtcaactgttcaccttattaaataatggttgaactgcatcagctgcgtacggaaatactttttataaaaagagtgagggccaagtttgccctcactttggtacaatcggtgggagtgccggttcattcttctattcttaccagatgataaagtgttccccggttcgatttcttgttgaggatgtccagcttgcggagcgtgcgtccgaaagctgctatccggttgatggccaacttatccctcgttttctgttgcaggtcgttgaaaatctgcatggctgtgagccattcgccttcttcgctctcctccgcgccacggaaatggcaaaggaaaagttcttccaatgggtctacccgctcgaattcccggttgtactcctttacgattgcttcgtcagtgtcgtccagccagtagcgttcacccttcatgatgtcgtgcatggcttgggcatagagctggtgataattgatagtgacgtttgtctggataggaccggtcacttcgatgcagatgaaacggcgacttcccgacgggtcggtcagcaggtctttcagattgctggtcccgatgaaggaggcatagcggcgcatttcctgaatagtggtaccgtagggctttcgcaggttggcaaccggtttttgcaggaggtgcttcaagaagccttgctgattggcgtttatctggtcgaattcgtcgatgttaatcagaaaaaagcggccaaggctgcgctccgcttcctgcttgctcttgaagtcgatactgtcggtgtagccgaaacgcagttccggtggcaataggatacggcagaaagtacttttgcggtaaccttgcggacctacgagcaggggcgaggtattgttgccgtgctgtttgtcgattccccgccaatgtgccaccatgccaagaaaccaccggtagaacagttccctccagtggggattgtggcagggcacgaggtcggccaatgcgcggatgcggtctttgccgtcccagcgtccggtgttatagagatattcttcgatggggttgtatagcggcacgtagtccgaagacaggaagcgggtgatgtcgcggtcccacacacgtactccctctttcagtgccttcatggcgatgctgctgcgtacgcgctggtcggcaggttggaagtagaagtggatggagtcgcgctgccggtattccaagtcgccaagcacggtgttgtagcggaattcgtagcggcgtttcatgaactcctccagccggaaagcagtttcctggtctttgttcaggctgctgcgggtgccgaagcctttcaattccccgtaaaggttatgcagcgtcaggcgtacaaggggttcgtctgcctcccggtagtagtgcatcagtgtctggcgcaccgcttcttcttcaggaatgccggctttgaagcaatgttcggcaaggcgggacagcagcgggcgcaggtcgtcgccccgtcgccagttgtccaaatcgcggaaggcgcggtcgagggcggcctcgaagagcaggttgcatgtgtccgccacttcgtagccgggagtcattctcagcaacggattgctttcctgctgtttccgttggcggtagttgtcttccgagggcagggcgcagggctgttccaggcagaaggccacggcggtggggctataatagggctgttcgtccacggtcatccggcagctttgtaggagtgaaggagcctggagggtgatggggaaagggagaaggggttggtagcacttcactgccaggcggtaggcgtgggcgtggaataaggcgatatcgtcttcattctttggaagccctccgtcgggcagggtgaagcgtacccatattttggcgcttcgtccgctggagccacagaaggcggcaaaggtttgcggcagcagggcggcttgttgtttcaccagttcggcttcggccaccccggccagattgtttacttccagtagtatcagcccgttgtaggtctttatccggtgttctcctgctttggtgcgggtcatttctacggcgggatagagacgcggcagtctgtcgatatgctcatatcgggcgttggtccctttcaaatgcgggatgatgctacgcagctccgtaatgtatccggtcttgttctcggttttcagcttttccatcaacatgtccgttttttgtgtgctgacggcctcttttccgctttcgcgttcctctctgatcagtgtgattttcattctttatcgtgtatgtaatattcttgtaaagatacgccgggaaaggggggggatacaagcttttcaaggattattttccgattggcttcttttttggggtggaatgtctatatgtttcttttataaaaggtgttcgtttctttgcttatccccatagttttgtctacttttacaccagagtttatgaacagtccactaaagtggtctttcttgttcatattagtgaacggagcagctcactacagtgaacggttctgctcacgggctgggctgtgatataacctttgtacttcaacagactgcgtacgtacttcgcacgtgttccgtgcagtgctttatcgtataatgtaaccctttaacgcagtttgaactatggctattttgtttgattggtacgagaatccggactcgtacgacaaatctccggaagataaaatccttcatccccgtctccgcctaaatgggagcaggtctaccgatgaattgcggcgggacatccaggcacgttgctcattgacagaaaccgatgtgacggctgtgctcgatgctgtgtcgcacgtcatgggcagggaacttgccgaaggaaggcaggtgcatctcgacggcatcggctactttcgcgtgtcgctcaccacgaccgaacgggtagtggctgctaccaagcgtaagttgacgaaggtgaagatggcgggtgtgaaatttcgtgctgaccagaaactgaaaaatgaaattggtaccatcaaggcaaaggctttgaaggcaaacgagcattcggctaaactgacggataaagagatagaccgtcggctgaccaactatttcgccactcgcccttttatgacacggaatgactttcaaagcgtttgcggcatgatgcgtactactgccatgcggcatatccgtcggctgcgcaccgaaggaaagttgaagaatgagggaacaatgctgcaaccgatttatgtacccgtttcaggatattacggtaagaatgagtgacttataactttgaacgaagaaatcttgtggtgagggcaaattttgccctcactttttaaatttgctctcacccacctcttgaatgccgatgaatagggcgatgcgtgcgaaaggtgagggtggtgagggtggatgtgtgaaatttagtttagtttgatgggcggctgaatatgggtattcccatacggtgtatatgttccaaaaggtcggcattctttaatttgccatagatggaaaggtctacgctgtaaggcaaaagcaggtcgtctatttcatcggaaaggctgcttaaagtattatacgtaagtctgtctcccatcagcgtgatgtctatgtcggaaaaaggcttgaaatttcctttggctcgtgagccgtacaaaacagcctgctctatttcttcatgtttccggaagagattgcatagcttttccagttcattgtcggtcaatccgtacatagctcaatcgaataaggatggtgtattcaaggattgcattttctcttcagagactacatcgttgtcatgattgtgcgatgtcagatttcgggcttctatagtctccgtccattgcttgtcatcaatcaatcccatttcaagggctttgcgtatggcatcacgggagctgcggatgtcggtatacccctgatattctgcatagtccttcatcactttccaggccagttcgtgggtatattcaaaacgctgtatccatcgtatgtcttgctgtaccatgatagctgtctgtttttaagtaagcaaatataagcttcttttgtgtaacgagcaaatggatgggggctttttcgtgaaagctgtctggggctattttggagaaaggctgtttttaggtgtggaataagttcctgaatttgttgagccgatgtcgaaatagttatatatgtatgttctggttccacatgcatttatgaaatcaaccgttacgcaaactcgttcaatttcatgactgttccgactgctgaaagtagtgaaataatatccttgcatgtctacctcccaatcgcagtcaacactccaatgaaaatcatgcgcaccttcaggaataggattcaatccgcattcacctccgctttgtgacagatagccatatataatgtcatggtcattttcttgtattcctgatacattgaaagtaattggtttggaaaactgaacagtgtattcctttgtgtgtactattgcggttaaggtcgtataaatggaactgcctccgggtgtccctaaattattcagggtgatagcaggtgatgcctgatttaattgcgaatataaatcgttgccaacaatccaatccactgttgcttttgtgggaaaattcttgatactgaatgtcccgttgtcacagattacgtcagggccaatcagttgcattgatgtcttagatacactcaaaggtagctcattggtaaaattatcggtttgatttttatatttgtagctcactttgacacttgcgttaccgggttgtgtcggtacgattgttaccgtagagctgttctgaccacttactatcttaatattcttcccggtccaataaaatgtatgtgccttgctgtcattgatggaatatatgtattctttatattgttcaatatttctgtagccatctatttgaggacccatattgggaaaactgatattgcttttccgagccatgaaatactcttttgctccgatagaatttatgtagaaatcatggacttctactccgacatcgctgttcttgaaggcttgctttgatttcaaatttatttggaatttgctttgtgtgacagatgcactttgagagacttcagcgaatagatttttatcgtaagtccactttatgcccgtatctttgtttatggaataattgcaccaaagtgttatcgtatctcccaattcaaatgttgaaggggcattgattggcataggtttcattttgacattgatgtttcttagatctgcggtaagttcgattgtacttttttcaggacgtaccatcagggtagaattactacctgctttagtccataatacatttattggaaaatggttttttcctgctggaatttgggttacccatgtactctcgaatcgttcttggtagtttgttttgaatcgtgcttctccaccgactgctgaaattcttatacctacagattgtttttgtataggaatacttaaatcataagtgtagtaaccatcactaacataggggttcatttcgcccgtaatagtaccgcttatgtaggaagcacgtgttgtgacatcagaatagaaatccttatcttgtaactcgtctgtttgttcttctttgttgcaactactattgatgaagcagattagtagtacgaaaaatatgttcttctttttcatgatatgtttcttgttagtatgttatgaacgaagggaaagtatatgatattgatttatggttccttttagaaggtgctattcgtgtttctatacaccttttaaagggaataacaaaagcgtccatacatttgtatttagatacatggaatgtatgaacgctttaattaaatccaaacgaggtacagcgcgatatgctgtttttagttgattaccaacccggattctgcttcatgtttttattcagggtcaactgtgtagttggaatcgggtagaaataatgtttggcttcataagtacggatttgtgcatcggaggcatctatatatccgttcttggtcgcttcttcacagtcaggcacattgcttacgttggcgcccaacatggtgttcgggtacttggttgaatccaatttgtcgagctggtgccaacggattaaatcccaatatcggtaccagttatccataatcagttcgcaacggcgacagcggcgtatctcccaaatcagattgcttactcccatattattggcaggatcggcatctggagtagttgtcatagccggcaggccggcacgagcctgaagcttgtttatggagttgttgagatcgtcttgtgtgagagaacccatttcggctttggcttctgcaaagttcagataaataactgaaatccaatagagcgggcagtcggtgtattggtagccgatgttgtttcggtcgctaacactcaattcttcggggttatcatacttggcgatgccataaccggtcgatgtggtgaaggctgctacaccggcacggctgtaggcgtggcctctgaaagaaagtaccgggtcaagaatttcggacaggcgcttgtcgcgtacggccaaaacctctcttatagagtaatttttgtctgcatccaatacggctgcatcgtccttgtttttcgaggttgttgccaacggttttccatcaaggaaaaggaaactgtcgaatgcgtcctttgaaatgccgtgcgtaccacttgtattgattgtgtagtcaatggtggagtgccttaacgaactttgtgcataaggcttgtagaaaatcatttccggattgcttgccaggctgacagaattatagttggctttgtaactgttacttagagagtagtttttggccataagatattcgcaggctgatacacattcttgcaagtatttgttggcgcggctctcatcagcggctttgccattctcagcttgagtgcgatatttgcagtatgtaccttcatataaggtgatgtctgctttcatggcatatgccatgtcggtgctgaaacgttgccgattgctgtttgcggtaatgtgttcgcacgcataattgatgtctgccagcacatggtccatcacttcatcccggtcggtgcgtggtccgtagagggcttcgttgtcggctgggtcgataactttgtctatccattgaacatcgccgtacatacggaccaactgatagtattcccacgcacggttcatgcgtgcaagaccttcatagtgggcctttgttgcttcatcaagagaggaagactgtacaccggcaatgatatagttggcgcgtcggatttctgtgaaaggggctgaccagtttgtggaagatgcgaccacgttagtgtaagtccagttatggctttctgcatctacctggtcatcgcttattgttttgaagtagaaccatcctccactggctccgttgccaaagccggtaaagttgttataaaaagtattgcactgattatccaaattatcggtgttgctccagtatgccggagtattcgtgaaggtatccaagggggatttgtccagcaaatcgttgcaaccggttaacatcgccagcgctgtgaccccatatataaataatttcttcattgttcttaagtttttgaggttgttataatgttacctggactccaaatgagaatgtgcgtgtaataggagctatacgtccccatccaccggctgtaagtccattgcctgtactgatttcggggtcgactggaaggtcattccctttgtggagcagaaagaggttgctgccactgaagtagatacgtgctttctcaatgtaggctttgcgtgtccactctttcggaagggtatatcccacagttacgttcttcagacgaagataggacatgtctgtcaaatagcgggattggggatagtagttgttgcagccgttagctataccggatacggtacctccactattatttgtaccacgataaagacgtggataacggttgccttgatttacctcataaccggtaatggcggtatagtctgaattccaaagcactttgttatagcttgtttggtgggaatagatggctacgtcggcatgtaccatggcgggaaggtttagggaagaagtcgtccagtcctcacgtttgcctacaccttggaagtagaggtcaaggtcgatacctttccacgctccgcctaaatggaagctgtattcgtagcgtggcatagagtttccgatgactttcaaatcgccgtggtcgtctgctgtgccttttccaccgtcaatcttgccattgccgtccaaatccttgaacttgacgtctcccgggccgtaatggaaattaccggattccagtcctgcctggcttgcaatgccgtttgcataattccatgagccgtctgcattttggctggtgaagtctttttcctcgaagtaacggtcggtttcaaaaccgaaaatgtcaccgtaggttttaccggtgtaataggtgctgagcagtttggaatcattgtcccactttgttactttagtcttggagtcaccgatgttgaagttggcatatacgtcgaagtcgccgaaggtatggcgccagttcaagttcaactcccatccacgtgtacgtaaggtaccggcattttcataaggagcagaagcacccagagtgttcggcaatacttgtgccggtgccagcatgtcacgattctcacgttggaaccagtcgaaacctatagtcagttcgtcattcaagagacccaggtcaagacctatattgagggtgcggatacgctcccaggtcaaagtacttgataccaaatccggcatgttatacatggtcaggagattagcgttggcattattgttttcaatccaatagatatagccggtacttttattgttcaaccgttggcttattaattgttcgaacatgtagtcgcccacagcctcgttgccgatttcgccaaaagaagcacgcaacttaccattgctgacaatatgtttcagtggggcgaagtaggcttcttcggagaagcggtagccgatggatgcagaagggaagaaggcccactggtcggtatgggggaaacgggaagaaccgtcgtaacgtccgttcagttccaataaataaatgcctttgtagtcataattgatacggccgaaataaccggcagaagcgcgggatgtatgattccaactcaaatcttgtccatccttgccagccatattcagttcggggtatccctcttgatcgtacatcacattgcgggtaccatacagatatttgtattcctcttcttctgcgttgacacctgccattacattcagattgtgttttttggcaaatgttttggtatagtttacgtatgcgttggccgtccatgtgttctgtttggaaaagtctctccagataccgctattgcctttagtgacgatgtaagagggtaccggtttcccgctccaattgatgccgtaaacggagttgtcctgcgaaccgctgttcatattctgaatggcatatgtaaagtctgcattaagggtcagtcctttaacgatttcagctttcaagaaagtgttcatacgggtcaggtctgttgtcacttcacgatcggcagcttgcttctgcatggccatgacgcgtgtgtcatagccgtcgattgtgcccgaaggaatgaaataagaaccccaacgccacaaatattggtaggtgttggcccatgtgtccgggcgtttatagttcttacgactatagttgatgcgtgcacccacctgtagccagtcgtaaacattagtggtgacattgactgaggcattgtacttttttagttcgtccgggtgaatcttcatctgtccttgcttttcgttgtagccgaaagataggtagtaattggtcttaccagatgttccttgtatagaaacattgtggctcatggaaggagcagctttgttgaagtagatgtcctgtacatcccagtcagcataataaaaaggagtgccgtccaatacgatatagtcacccacgttactatcgctttggtagaggttcataggacggtagccggtcttgccgccgttctgttgctgccacttttcggcgtaaggtaacaatttgtcgaaatacataccgaacaattcaggcataccggcaccaccgttcatactggcttcgatacccatctttaattgtgtgggtacatcgggatagtccggcaggtaagtagcttgatcccatgcaaaattgttgctgtaattgatggtaaccttttcgctaggctttgcgctcttggtattgattagaatcacaccgaaagcggcgcgcgttccataaatggaggaagcggaagcgtccttcagtacggaaatattttcgatgtcttgcgtatcgaggaaagaaatgtcatccatcggaacgccgtccactacaatgagtggattgctgacttctccattactcaatgtccccaaaccacgtatacgcatggaggctgtctcgtcgatggcaccacttgtggtgagaatgcttagtcccggaacagccccttgcaatgctttggctacatcttgttgtggacgacctgccattgtcttgtttaagtccactgtagaaactgctcctgtcaagttagccttcttttgtacaccgtagcctactactactacttcatccagcatctcggtatcttctttcagagttattctcatcgttttggctgccttcacttcttgtgtctgatagcccacaaatgatatttttagtgttgctcccggtgttacggtcaatgtaaacttaccgtttaggtcggtaattccgccgttggtagtccctttttctactacgctggcaccgataatcggttcgccggctgcatcgacaactaaaccgctgatggtgatagcttgtaattgttctgttacaccaagcgatttatcaggattggcttgtgcagccatcacgttgccgctacttaataacagtgagctgattgccactgctgtgaggagtttgctatgtgttagtcctcgttttttgtgatcttcattcataaatgattgatgatttgttgttaattaaatacttcttaaatttagggtaagggtaataagggccgaatagtgagactattcaacttgcaggattgtttctttttccataggcattttctctttttaaaggttcataactttatattatctcttgttttcctatttgtttgccaagtccagacggaacttggaattcagccagatagtatcttattgttagtctgttatcgtcttgttttgactaaaacacggttgcgttggaaaagtgggaatactttgttggatgattgaagacatgagcaaaagggagatgtatggccagcaaaatgattttttcttgaaatagccttggaaagattaaaaaaagctatatatttgtattcaattctaaaactaactacctatgaaactaattgcagaaagtggttctacgagaacagaatgggcgctggttgaagataatcgtctgatacagcgagccttcacagagggcttaaatcctttctttcaaacgagaagagagattagccgaagtgtgcggttaggattacccgagcattttttcaaaaggaaattggaacaagtctattattatggtgccggatgtacttcttatgaaaagaaaaatgtattgggagcttcattggtagcacaattcaaaactccaattcaggtagagagtgatttgctggcagctgcacgtggcttgttcaaatgcgaggccggcattgcttgtattttgggaaccggctcaaactcatgtttttatgatgggaaaatcgttgtaaagaatgtccgggcaggaggttacatcctgggggatgagggtagtggtgctgtattgggcaaaatgttcttgtctgatgtactgaaaggtttggctcctaaagatgtaacggcggatttctttgagaagttccgtataagtccgaatgaggttatggaatctgtgtataaccgcccgttccccaatcgctttttgtctactatatcttatttttttgctgattataccaatgatgactatgtatttgagctgattaccggtaatctgagaaatttctttactcgtaatgtctgccaatatgactacaaaaattatcctattcgttttgtgggttcattggcttacagctacgcgaccattttgcgggaagttgcccgtgaatttggcatcgaactggaaatcattgaagaaacaccaatgaatggcctgattgaattccattctttaaatatagaagaaccttaaattctttatataataaggtgtataacctcctttttgcaaatgtataaatataaagttaaataaatgcaaaggaatgttcttgatattaaataataatgtatctttgttaggacgaaatgaatgaatcatttctcacctttgttaataacgagttttttatctcttaaaacaaccaatagagttaagtaattaacaagattttaaccttgtataatatataactaagttccgtctggacttggtaaataaatagaaaaaagagagataatataaaaatgtgaacctttaaataaagaaaacgcctatgagaaattaaagaagccttcggaaatagtctgactaatccgaactatatgattcccttaccctaattttgaaaaactggtttaattaacaaaatcatcaatcacttatgaatgaagatcgcaaaaaacgaggacttgccaatggtaagttctttacggcggtggcaatctgtgctctgtttttaggcagtggcaacgtgatggctgcccaaacagcatccgacgactcgcaaggagtacaagaacagatgcaatctatctctgtgactgttacagttgtagatacaaaaggtgaacctattattggcgccaatgtcattgagaaaggtacgaccaatggtggtattacggatttggatggagtttccaaattaaatgtaaagcccggtgctattctgcaagtatcatttgtgggatatactactcaagaagtcaaggcaacttcggtaatgaaggttgttttgaaagatgatacggaattgttggatgaagttgtcgtagtaggctatggtgcacagaaaaaggtgaacctgaccggtgcggtggcttccgtggacgtgaacaaaacaattgatagccgtcctatcacggatataggccgtgccttgcagggggcggtaccgggattgaccattactactaactccggtgagataggtggtgcgcctactatcaagattcgtggtagtatcggttctccaaatggtgactccaaaccgttgattctggtagataatgtggaagtaacggatatttctatggtgaatccggacgatattgaaagtatttctgtattgaaggatgccgcttctgcttctatttacggtgcccgtggtgcatttggtgtattgctgattaccacaaaatcaagaagtaaacatgaacgtctctctgtaaaatataccaataactttgcatggcgtacgccgaccaagacgcccgaacaacttccgggatggcagcaggctgatattaacttgcaaggtgtaatcaatcagactaaggggtctaccgcattttataacgtagtgggtaatatgcgtgtggatgctacacatgtacagaaaatgaaggattactgggacaaatatggttatggtgaccagtttggccgtgagatggaattgggtcgtgactttgagttccgcgatggcggtatgttctttatccgtacttgggactggtatgatgaatacatcaaagactgggctccgcaacagaaccatagcctttctatcaacggtggcaacggaaagactaattacaatatcgctttgggatatctgagccaggatggtatgatgaaagtcaattcagacaactataagcgttacaatgccaatatctctttgaactctgaattgaaccaatatgtgtctatccgtacaggtgtcatgttcacccgttctgactacgataagccattcaactataacagtgatctttacgacccgatgtactatctgtatcgttggcagccgatgatgccttacggtacttttgaaggcaaggagttccgtaacgccttgaccgaacagaaaagtgctcctattaccacaaaagaacgtgagtatctgcgtttgacaggtggtgcaactatcaagcctatcaaagatttaacactggatatagatattgcttatagcagcgtggaaaatcgctataagaagtatggtacaccgagcttgaccagtggttatgaaatcttcactgcccgtccgtctgttgaggcattacgtgattcttatggcagttatctatctgctgctacttatgattatgtatatcaggaaaccggacgcacggagaatttgacagccaatttcgtggcaacttatgccaaacgctggggagatcatgactttaaggcgatggcaggttccagccttgaaaagagcgaatatgaatattactgggcacaacgcaaaggtctgctcgaccccgcaaaaccggaattgaatctggctacaggtgaccagactacaagctcctcgcatacatggtggtctgtagcaggtttcttcggacgtcttaattattcttataaagaccgatatatgttggagctgaacggccgttatgacggctcctcccgtttcccttcgggcaaccgcttcggtttcttcccctctatgtctgcaggctaccgggtttcagaggaacctttcatgcagtcgttgaaaccttatttgagcactttgaaggttcgtggttcttggggtatgatcggtaaccaggatgtaggtaccgaccgttatatctccactctgtccacttctgttgacagttggattatcgatggaaagaaagtacagtcaacacaaaaaccgactattgtgtcttcaacccttacttgggagaaggttactacacttgaccttggcttggatgcccgtttcttcaatgacgctttgggagtaacgtttgattggtataaccgtactaccagtgatattttgactactgccaacctacctgccacattgggtgctgacgctccatatgaaaatatgggtactatccagaccaaaggatgggaacttgccattgactatcgccataccttcaagaatggtctgcactttggcgtgacggcttctgttgccgatgacaagactgaagtaaccaagtggacgtataatacaaagattccttcttatggagctaccggctggtgggataagagtgcttataaagaaggtatggttttgggagatatctggggcttgcagttcgaccgtttcttgacggaagatgactttaatgctgacggttctttgaaagccggtttgcccgaccagactaaagtattccctgccggttatcaatttgctcccggtgatgtgctttataaagacctcgacaacaacggtgaaatcgtaaaacagaccaatacaaatgacaagggtgaccttagtgttataggtaacgccctgccgcgtttacagtttggtttgaatctggatgctgcttggaaaggctttgatataagcatgttcttccagggggtagccaaaagaaaactttgggcggcaggtaaccaggtattaccaggctttactaccggtgaacccttctacaaaggtgctgaggattattggactcccgaaaacacagatgctttctatccccgtccgatggattacaagcagtctgcttcgggtaactatagcgtgaatgaccgctatttgctgaatatggcttatctgcgtctgaagacgtttactgtaggatattctcttcctaaggtttggttgagtaaattcaaagtgcaaggtttgcgtgtttatttcactggtgaaaaccttttcaccatcgacggtgtgaaacctgctatcgatccggaaataggaatacgtacggccagtggtaagagtgaccagcgtaactttggccgtagctatccataccagaagacagtgtcgttcggtattcagcttagtttataatctaatagtaattgcagttatgaaaaagaaaaatttattatacatcgtttgtgcgttggcaatgggctcgctctgcggttgcgacgattttttgaataaagacccgcaggacaagcagaccaatgacacttattggcagactgaaacttctttgcgtacttatgcgcaagacttctattcttcctactttacaggatatggtaccgactatactgtttttgccggttatttctctggagatgactatacggatgattttatcaatctgaataatgcaaatacaaacggttcaggatatatttatttctccacttctgccactacggactggaatagccagacaggaacttggtcgggcaattatagtgttatttataaagccaatgtcatgcttgagaagattcccggaatgaatatttcggacgaagccaagagacactgggaaggtattgcacgctatttccgtgcaatggcctatagtacgctggcaaagtattatggcggtgttccttactacgataaggtgacagacccggcagacccggctctttataaagaccgtgattcttatttgtatgtagcgcagaagatacaagaggattttcaatatgcattggataatgtacgtacggatgatacgaagcgccaagtcaacaaatatgtggttggtgcgtatatgtcacgcgaaatgctgtatcatgccacatggctgaagtatcacggtactactgtaggtcctacttcagagaaggtggcggatggtgatattaagaacttgctgcaaggagccattaatggtgcagaggtagtgatgaactctggtatctattcaataggcaatacctataatgctttgtttactacggacgatttggctaacaatccggaagtcatctggtatcgtgaatatacaagcggtttgcagtgtaatgctttgatgtcctacaatggtccggaagatcagactcagggtggtgttacgcaagatgtaatcaacacttatctttgtagtgacggtttgccgataggtcagtctccgctgtatcaaggtaaggaagacccgagtattcagaagtcatttcaagaccgtgacccgcgtttgtatcaaacagttgccgacagtcttcgtatcatgagcgccatggggacaaattataccgaaggtacatcaccaacgggatatcctaccaaaaagttcttgaacgacgagtggtgggtggctggtctggattattgtaccggtagattaagtccggctgatgcgccgtgcatccgctatgcggaagtattgctgaactatgtagaggcgcgttatgagattgcccaagtgggtggtaacgctttcactcagagtgaccttgacaagtctatcaatgaactccgtgaccgtcagctgacgaagtggggagatactgaagccaagacaatgccgaaagttcaactgaatggcggcaacttgagtgtgaatggagttgttatcaatgaccctgcccgtgaccctgatgtcaatccggttttgtgggaaatccgtcgtgagcgtcgtattgagttgattatggaaggccgtcgtggtgaagacctccgtcgttgggccaagtttgaatacttaaactcagaagatgcaaatggttatcctgccatgtctttcctgggtgcttatgtcaatatggccgattatccggaaatatcttcaaaagatgattccggcaagagagtgctctatctgttcgacccggagaatccgggtaatgaggatactgaaaaagggtatatttattatcttcgtgaaaaggaacttcgtatattcaaggctggtgaattgaattcggaacgctactatttgcgtgccataccggctgcacagctgactatttatgagaataaaggtcaggtgttgactcagaacccaggctggtaataccataaagtggattataaaaataagggatgtcatttctaggacatcccttattttttattcattgttctcttacagtgccttttccttaatcaggtattctgcaatctgcaccgcattcagtgcagcgcctttcttaatctggtcgcccacaatccagaacgtcaatccgttttcgttgctgaggtccttgcggatacggcctacgtaaaccgggtctttgcccgcgaggaacaacggcatggggtattccttttctgccgggttgtccatcaacaccagtccgtcgcctttggcaaatgcttcgcgggcttcttcgatggagatgggacgctcggtttctacccagatgctttcggagtgggagcggagagcgggaacacgtacgcaggtagcactgacttttacgtcagagtgcataatcttacgggtctcgttgaacatcttcatctcctctttggtatagccgttttcggtgaatacgtcgatttgcggaatgaggttgaatgccagctggtaagcgaatttctcaacggttacgggttcgcctgccaatacctggcggtactgctcgtacaactcatccatggcagcggcgccggcaccactggcagcctgataggtagaaacgtgtacggtctttatatgggaaagctgttcgatggctttcagtgccactaccatttggatagtagtacagttggggttggcgatgatgccgagaggacgttctttggcgtcggcggcattcacttcgggcactaccaaaggtacattgtcgtccatacgaaaagcgctggaattgtcaatcatcactgctccgtacttggtaatggtttcggcaaattctttggaggtgcctgcgcctgcggaagtgaaagcgatatcaacccctttaaagtcatcattgtgttgcaagagtttcacctcgatctgtttaccgcggaaggtatatttggttccggcactgcgtttagaaccgaacaatactaactcgtccaacgggaaatttctttcatcgagcactcgcaggaactcttgtcccacggctccgcttgctccaacaatagctactttcatttttcttttgttttaaattaagtttataaaaagtgaaatactatctctaaaaagatagaattggtcgcaaatttataacaaaatgctgtataacaccgcataaagtgaaaagtttttcgttattttgcattcaaaacctaaaacttatagcctatggattggtttgacttcagcttgaaacttcccatcaccgaccctacatggatattcctccttgtactcctcattatattgtttgctcccatattgttgaataagcttcgtattccgcacattatcggaatgatactggcggggcttgtcattggggagcatggtttcaatatcttggtgcgtgacagcagttttgagcttttcggcaaagtaggcttgtattacatcatgttccttgccggtctggaaatgaatatgggggacttcaaacagaaccggggcaaagcgcttgttctggggctcttggcttttattgtgcccataggcataggcttggtaacgaatatagctttgttgaagtacggggtactgacctctgtcctactggcaagtatgtatgcatcgcatacactggtggcctatcccatcgtgattcgttacggtgtgtcgcggcatcgcagtgtgagtattgcagtgggaggaacggcggttacggatacactcactttgctggttctggccgttgtgggtggtatgttcaagggggagtcggacggcttcttctgggtatggcttgtcataaaggttatcttcctgggtattttgattgtatatctgtttccacgcataggccgttggttcttccggaggtacgatgacaatgtgatgcagttcatatttgtgcttgccatggttttcctcggagccggattgatggagtttgtggggatggaaggcatcctgggtgctttccttgcaggtttggtattgaaccggctgattccgcatgtctctccgctgatgaaccatctggagtttgtgggcaacgccttgtttattccttatttcctgataggcgtgggtatgttgattgatgtgcatgtgattttcggtcatggcgatgctctgaaagtagcggctgtaatgattgtggtggcattggcaggtaaatggattgcctgctggctgacgcagaaaatatataagatgggagggattgaacgggagctgatgtacggattgagcaatgcacaagcagcggcaacgctggcggctgtgttggtggggtacaacatcattctgcccaatggggaacgcttgctgaacgatgatgttttgaatggtaccgtcctgctgattcttgtaacttgcattgtgagctcgttcattacggagcgtgccgcacggaagattgccatggaggaggcgcatctggaagaaaaccgctccgtggaagcggagaagatattgattccgatagccaaccccgatacgattgaagacctgataaatctttctttggtgatacgcgacccgaagcaacgggataatttgttggcactgaatgtcatcaacgacgatagcagttctgaaagtgccgaattgcgtgggaaacgctatctggaaaaggctgccatgataacggcctcggcagatgtgccgttgaggcaaatcacgcgttacgacttgaatatcgcttcgggcattatccatacagcaaaagaatatgcggtaacggatgtcattataggtctgcaccgtaaagtcaatattgtggattcattcttcggtatgctgacggagaatctgctgaagggcttgcatcgcgaggtgatggtttccaagttcctgatgcccattaacacaatcaggcgggtgattgtggcggtacctccgaaagccgagtatgaggcgggattcctgaagtgggtggaacatttctgccggttggggagtactttgggctgtcgggtgcatttttatgccaatgaagagactaccgcccatcttcaagggctggtgaaagccaaatatggacagacattgacagacttttcccgcctggacgattggggggacttactgatattgaccggacaagtgaactttgaccatctgttagtgattatcagtgcccgccggggctccatctcctatgacagctccttcgagaagctaccggcacaaatcagcaagtactttgcaaataacagcctgatagtactctatcccgaccaactgggcgagccgcaggatgcggtatccttctccaacccgcgtggtaacaacgagtcgcagcactacgagaaggtaggcaaatggttctataaatggttcaagaagaattgacgattgacaattgataattgacaaaaatctgtgtaaatccgtgtaatctgtggtgaaaatggaagattggcaacaacgaacgcaacttttattaggagatgaaaaaatggaacgcctgcgccgggcacatgtacttgtcgtaggactgggtggtgtaggtgcttatgcggccgagatgatatgccgtgccggagtggggcggatgacgattgtcgatgccgataccgtgcagcctacgaatataaaccgtcagttgccggctctgcattctaccctggggcaaaagaaggcggagatattggcatcacgtttcagggacattaatccggctctggaactgagagtgttgcccgtattcttgaaagatgagaacataccggaactgctggatgatgcggcttatgactttgtggtggatgccatcgatacgcttgctccaaaatgccacttgatagcggaaagcatgaagcggcatatcaagatagtgtccagcatgggggcaggagcaaagagtgacatttcgcaagtgcgctttgccgatatctgggatacctatcattgcgggttgagcaaggctgtgcgtaagcgtctgcaaaaaatgggcataaagcggaaacttccagttgttttcagcaccgaacaggctgatccgaatgccgttttgctgacggacgacgagatgaacaagaagtccacctgtggaacagtgagctacatgcccgcagtttttggctgctatttggccgaatatgtaattaaaagactatagtaatagcacttgaaagaaaactatcaaatagtaaatagtaaattgtcaaattgtaaatagcctagtgattcatttagagaatataacgaagagtttcggtaacctgcaagtgttgcggggtattgacctggagatagagaaaggggagattgtcagcattgtaggccccagtggagcgggtaaaactaccttgctgcaaatcatgggtacgttggatatgccggatggcggttcggtggttattgacggtacacaagtcaaccgtatgagggagaaggaactttccgcattccgcaaccaccatatcggctttgtgttccagttccatcaactgctgccggagtttacggctttggagaatgtaatgataccagccttcattgccggaagaggacagcaggaagccaaggaggcggctacggaaattcttgaattcatggggcttgccgaacgggcctcccacaagccgaatgagttgtcgggaggtgagaagcagcgtgtggcggtggcccgtgctctcatcaatcatccagcagtggtgctggcagatgaaccttccggcagcttggatacccataataaggaagaactgcaccagctcttttttgatttacgtaaccgtttcggacaaacgtttgttatcgtaacccatgatgaaggactggcgcagctcaccgaccggacgatacatctgattgacggggaaatcaataaaatggtttgagcctatttccccgtgcccattactcccgagtcattgtcactgttgtttaccttccgctgtgccgtcttgaaactgcggccgaacgagaagttgtaggaaaagttcactaggaacatgcgggagctttcttttatataattatttgtcttgtaggatgcgaatttattccagttttcgctttgtactttatagttgtcggtgaaaggattgaatgcaccgactcctacccgaagattcttatgcttgtaatatacagctaacatctggatgttttctcctcccgagagggtttctccccagaaattgttccaattggtgtttatctgccagaacagagagaactgtttgtagtttaatgaggcttctgcctcacaaaaccagttggtgtaggtatgcgagtagtgattgccatggctcatgtaatggttgacaccgcccgtaaaagaaaattgcagaatgtcgcggatgggtcctacgcggagcatggcacgcccggagagtttctgccaatccttctgattgtcccaagtctgcactattttgttgccttcttgaatcttctcgtccataatggcattgggacgatagtcataggctccccatagattggtataaaagatgccttttttccattcgtaagtcagttccgtatgatagcacatatatgatttcagatgcgggttgccacgacgtatctggaatgagtccactgcttgctccacatcgctgaggtcgcccaatgaaggagaagcgttatagatgtttcccttccagcggagataggagttgtctgacatggcatagtgcagaacgatactcgggttgaaactgtagttctcggtagatttgtccttgccgctctgattatagtagaaacgagtcatggccactcccagccggtagtttagtttgtctatctttccacggtattctccgaatatgtatgtgttctcttggtgcatattggtttcataataatgcccgtttctgtattcattgttagagtaggactgtgtatggctcagaccgaagctcaatgcgttccccttggaatattgcttctcataaatggcctcggcaatcagggagtatttgttgcctcggatattgttgtcaatatcggtcaatatgttccccggggtgctttcttggtagagccgctgcgatttttcccgattataggtgcctactacattgaataccagggtttgtttgtttttcaggtcttgttggtagtacaaatcgagtgagggacgtgtccagctctggtcggtacggtcggtcatgtctaccacgtccgcttcgtcattggcgttatagagagttcctttataatcccagtgcggctgattgtttcctcgaaggcggaaggtggcgctgaaaagggaattttcagaagcctgcaaactgtaatttacgtttaggttgtgctggtacatggttgccttgctgggctctcctttctccaggcgtctgagtgtagtgccgtctgccaggtggaattcttcttcattgtcgcggtacatgccgttaaaatcccgcggtcccatgtaatagaagaagccgaattctgattttttgtggtttactttgccgtacagattatagtttccccacatcgtgttcaacccttgggaaatgtcggcaccgaagtttccgcccgttttaggtcggcgcactatgtagtccaaaacgacttcggcattgccgtagcgcagtcccggattgtcatggtactctatacgtataatgtcggcagggcgaatggcttttatctcgtctatttcggctttgactccattgatgcgtaattgcagttctccaccgccggacaatccaatctcattgttcatggggttgaccagaatacgtggcagcatcagttcctgcaacagattcactccgtttgtggaagttttcatttgtctttcggatgggaaaaccagtttgcggtctgcacggctgatttggctggagccggtgatagtcactccttccagtgcgatagaagcactgtctaatacgattggtccaaggtcggtatggcgctttactccattgagggtgatgtatccggtattatacccgatgctggaaagaacaagtctgtaatctccggtagccgtgttcttgaagatgaattctccttctggacttgtggtcacaccggcgacaaaagtagagtcgatggtctgtaataccacattgacatactctatactcttgtcggaagcatcgcggacggttccttttatttctattttttgagcaaaagcattctgtgccatactgcccagcagcatggttataatcattaattttttcatattgatacgatggttctaatccttattgcagtaggccttcctgtttttagggtgtttctgcttgttagacgaaatgactggtgaaaaggttgcatcagacattgaaaaatgttgcatgatgctgttattcaaagcaaacgtagtgactgattttctccaaatcggtatcggagaattcctcgtaaagtgcaaaaggtttcagactatgaaggtcgcctttcttcttccggtattctacaaaggcctttgcctggtagaagttgatgtaaggatggtggcgcagcctctctatgctactacggttcaggttgatgaggtggatggcccgggtgtcgatggaaaaccaggactgcaattgggtggtgtccaaatggatttcttgtaattgcgtgatgttgtagaatcctcccaagcgttgccgataaccgatgattagacgggcaatgccactaccgatgcctggtattttcttcagttctgtggtgtcggcgcggttcaggtcgacaagggtcccagacggatatttttccggtgcaattcggaaagtaacggcgctgtcattgcttgcaggagagctgtacaactggacggttcttgtttctgtgtctttcggagtgatgtggatatagggtaagagtgtctgatattgtttttctgtcattccatatattttccggaaatcttctgccttatggaacttccctcctttactacggtagcggagtatgttccgtgccatccatccgggcagtcccagtcggcaaaaaatgacggagtcggcggtattgggattgaaacgggccaaggagacggttgtcggttgtttttgggaggaaggtttaagtctgttgtcccatttttgttccttttcttgtatggatgcgatgaacgattcgtattctgccatggcagtggcctgccgccggattacttcatcggagagggggcggttctctctttggtatatataaatatacccggagagaaagacgagaatgatgccggtaatcaaaaccagtattccgcgcctttctccccgggagaaataaaggaattctttaaaggggttctgcatgatgacctatttcagaaaacccagttcattgataaaaatcagtgcaattcctatcggagcaatatatttcaggatgaatatcaatagcttgtagacggatactttcagagtgccattgttgctgacttcttcccatacgattttcttgtccagataccagcctatgaagatggaaatgaagaaaccgcctaacggtagcattagcttggccgttacaaagtcgaacaaatcgaataggtttagcccgaatacggtatagcttttgccgataccgagagacagtgagcagaatactcctaagaaaatacagcccgctgtcacgtatctggctgccttgctgcgtgagaacttgaactcttcatgtagataggcagttaccacttcgtgcagggaaatggtggaagtaagtgctgccaatgccagtaggatatagaacatcagagacagcagtatcgccagccagggaatattgccgaacgcttgctgaaagacattaggtagggtgatgaatagcagactaggacccgcatccggtttgatgcctacagagaaggcggcagggaagatgatgaatcctgccaaaatggctaccatggtgtcgatagccgccacgttgagtgccgttttgggcaggttcgtatcattgcggaagtaagaagcgtatgtacagagacatcccatccccaagctcaaggagaaaaatgcctggcccatggctccaaggaacacattgccgtccactttgctgaagtccggtttcaacaggaattcaatgcctgctcctgctccgggcagggatatggagcagatggcaaggattatcaataggacaaatagcattggcatcatgattttggctgatttttcaatacctttttccactcctttgacaatgatgagatgggtggccagcaggaacagcaccagccagatgaccggacgccaggggttgctgacaaagctgttgaaggatgcgatgaaatcggctgccgacttcccggcaaaactgttggtagccgcttcgccgataaactcaagcgtccatcctgccacaacggagtaatatcccagaataaggaatccggccagtacgcccatacgtcctacccagcgccaatgcgtgccgggtgccaatttctgataagcccttgccgtattggcacgcgagcgcctgccgatgaggaattctgcaatcatgatggggatgccgagaatgagcacgcaaaccaggtatacaaggataaatgccgcacctccgtgattcccggtctcaaacgggaaacgccagatattgcctaaaccgactgcggagcctgccgaggcaagtatgacgcctaatttgcttccgaagttggctctgtcactttttgtcataaaacgtagatttttctttcaattcgttattaataccagctaaaacatgcaaatatagaaaatgttctgtacttttgtgcacagttcgttgataatttggtatatgctatattatattaagaaatatccggtgtcgctttttattattctgacggtgatttatctttcattctttaaaccgccttctacagaaataagcaagattcccaatatagacaaggtggtgcatatctgtatgtatttcggcatgtcaggaatgctgtggctggagtttcttcgcgctcaccggagagacaacgcccctttatggcatgcatgggcaggggcgtttgtctgtcccgttttgttcagcggaatggtggagttgctgcaagaatactgcacgacataccgtggtggagactggctggattttgcggccaataccacgggagcggtgcttgcatcaatggtcggctatttcattttaaggccaaggatgaaataggattataagtattcaactacggaacttagcttgatgccgttcgacccttttatcagaattgttttcccgcaaggtttctctctttgcagctctgcgatgagtgcggttacatcgggataactctgataagagtggcgtgtggcggcaaacaattcccctacaagaactacatccttgaatccgcattcttccagatagtctgcaatcttctggtgctcgtcggcactgtctttacccaactcccgcatatctcccaatatcaacattttgttttcggcctgcatgttccggaagttactaatggaagccatcatgcttgtgggattggcattataggcatcgataatcagagtgttgtccgctgtttttttcagttgtgaacggttgttttgcggggtatatccggccagtgccttgtctattttctccggttccacaccaaaaaaatgtccgatggtgacagctgccagagcattggggaagttatattcaccgataagccgggtttgtacttcgtgatatttgctttcgttgtccgttttccactcgaaggtgaggtaaggagaattgccggtgacgtgtccgttgatgtacagcccgtcctcactgccgtaggcaatctggtggagtccgtaggctatctttttcaagtaggggttgtcgttatggataaagatggtagcttctttccgcgtccgcagatagtcgtacatctctcctttggtcttgatgattccttcaaaagagccgaatccctccagatgggcttttcctacgttggtaatgatcccgtagtcaggttcggctatctctaccagctccttgatgtctcccgggtggctggcacccatttccaccacggcaaggtcgtgttcagggcgcaggcggagcaaggtgaggggaacaccgatgtgattgttcaaatttcccaaggtatagagcacgttgtgagtttgcgaaagtacggtggacatcagttccttggtagtagtctttccgtttgtacccgtaatgccgatgatgggtgtacgcatctgccgacggtggtaattggcaagttgttgcaaggttttcaagctgttttccaccacgatgtatcgtgtatcgccttcaggggcataggcttcttcgtccactatggcataagcacttccgctttccagcgcccgggcggcaaaggcatttccgttgaacgactcgcctttcagcgcaatgaataaagagccttgggggcagttacggctgtcagtagtgacactggtgcatgttaggaatatctgatgtatagctgttatatccatgactttataattaaatcaatctgtgtgaatctgtgtaatctgtggtaaaccatcgtgcaaagatatagttttaatcctctcccttcccgggtacaagcaaaaaacttatcagttttatgagtttatgtattttgaaaccacttttttgtttacatttgcaggtactatatagaacagactgcctatggaaattacaactgcccgatatataaatgtcaacggttcgctgctcgacctctctcaaccccgtgtcatgggcatactgaacgttactcccgattccttttatgccggtagccgtacacagacagaggcggaaatagtacgccgggtgaaacagatagtttcggagggagcggccattattgacataggcgcttactcttcccgtcctaatgccgacaatgtctctgccagggaggagatggaacggttgcgtatgggcctgaaaatactttttgagatacagccggatgctgtggtgtcagtagacacttttagggcggatgtggcaagaatgtgtgtggaggagtatggtgttgccatcatcaatgatattgcggccggtgagatggatgcgaatatgttccataccgttgcggcattgaacgtaccttatattatgatgcacatgcaaggcactccgcaaagtatgcagcagcatcctcattacgacaatcttctgaaagaggttttcttgtattttgcgcgcaaggtgcagcaattacgtgacttaggtgtaaaagacatcattctggaccccggtttcggctttggaaagacaatggagcataactatgaattgctgtcccatctggaagagttccgtatttttgagttgcctttgctggtaggcgtttcacgtaaatcgatgatataccgcttgttggacattactcctcaggaggcgctgaatggtactacggtgctcgataccatctgtttgctgaaaggtgctgacattctccgcgtacacgacgtgaaagaagccgtggaaaccgtacggattgtgcaagccatgcgaaataattcctagtccctaacccctaatcattcaatatcgtgttttttgaatttggaataaaagattttatagatattctgttagtggctttcttgttgtactatacgtataagctgatgaaagcctccggttctataaatgtgtttacgggtatcctggtgtttatcctgatatggctggtggtatcgcaggtgctggagatgaaattgctcggttccatcttcgacaagctggtcagtgtgggcgtgctggcgcttatcattttgtttcaggacgagatacggcgcttcttgctgacactcggctcgcatcagcatgccagtgcgctggtgcgcttcttcaccggtaacaagaaagagaagctggaacatgacgacatcatgccggtggtaatggcatgtatcagtatggggaagcagaaggttggtgccctgattgtcattgaacataatctgcctttggatgatgtggtgcgtacgggagagattatcaatgccgatataaaccagcgtctgattgagaatattttctttaagaacagtccgttgcacgatggagcgatggttatcagtaagaaacgtatcaaagcggcgggatgtatcctgcctgtttcccataatctggacattcctaaggaactggggctgaggcatcgtgctgccatggggatttcccaggtgtctgatgcgcatgccatcattgtatcggaggagaccggaggtatttcagtggcttacaaaggacaattctatctgcgtctgaatgcagaggaattggaaagtttgttaacaaaggaaagctaaggtgtgacaaaatctcctatttttacgtcatataactatgatataaaaaacaatatcttataactaataactgaaaaggatggatagacgaaatttcttacggacgggaagtctggcgatgttaggttcgctggcagtaccctcgttggctatgcctgcgtcagtacgcggagctttaggaggagcagataatcagtctgccgtagcttcggcaatggttcacttcggtgtgacggaggctgacttgaagaaagtgatggctgccgctctggaaaaaggcggcgattatgccgacctttattttgaacacacattcaacaacagtgtggttctgatggacggcaaagtaaacaactgtggagctaacattgacttcggtatgggcgtacgcgtattggcaggcgaccagacggggtatgcttatgtggaaggggtaactatggaagaaatgctgcgtgctgcacgtactgctgcccgtatcgcctcttcgggcaaggccggaaaatctgtaggactgacggaaaagacaattaccaaaagccgctatgccgtcactgaaccttgggaggacgtgagtgtcaaggcaaaaataccttatttagaaaagctgaacgaaaagattttctctttggacaatcgtgtacgtaaggtgcaggcttctctttctgacagtacatcgcacgtgctgttctgtaattccgagggcgtgagctactacgactaccgtccgatggtttcttttatggcagtctgcatcatggaagagaatggaaagatggagaacggttatgccggtcgttcttaccgcaagggttttgaattcatgacggatgacatcgtggatattattgcacgtgaggcggtggataagactgctatcttgttcaaggctgtgaaacccaaaggtggcgaaatgcccgtcgtgatgggggctggcggttcgggtatcttgttgcacgaagccataggacatgcttttgaggctgacttcaaccgtaaacgtacttccattttctgcgaccttttgggaaagaaggtgtgcgatgagcatatcaacgtggtggatgacggtaccatcgctttcaatcgtggagccgtgaatttcgacgatgagggtgtggaaggccagaaaacctatatcgtgaaggaaggtatcctgaccagttatctgcacgaccgcatcagtgccaagcattatggggtggctcctactggaaacggacgtcgcgatactttccgtaatactcctatcccccgtatgcgtgccacttatatggaagccggcaatatgaaggaagcggacattatctccaccgtgaagaaaggtatctattgtgaccagtttaccaatggccaggtgcaaatcggtgccggagactttaccttctttgtgaagtcgggttacttgattgaggatggcaagttgacgcagcccgtcaaggatataaatatcatcggtaatggtccgaaagcattggctgacatcacgatggtggcaaataacgataagattgacaacggtacttggacctgtggtaaagacggtcagtcttgtcccgttacctgcggtatgccatcggcactagtcagcaagctgactgtaggaggagaaagttaattatcaactatcaattaaagacatgattacagacgacaataagaaattggcacaatgggcaatggaatatgccttgaagaacggttgccaggcagccaaactggtgctatatacaaattctaattcttcttttgaactgcgtgacggcaaaatggaccgtttgcagcagtctacggagaatggtttgggattgaatctttatgtggacggacgtttcggttctttttccaccaatcggctggataagaaagaattggaaactcttatcacgaatggtatagagtctacccgctatctggcggtggatgagtcgcgtatgctggccgaccctgcacgctactataaaggaggcaagcctgacttgcagctttttgacaagaaactctatgaagtcaacccggatgataaagtggcgattgcacgtgctgctgcagaggaggtattgggcaaggatgagcgtatcatttcggttgattcttcttatagtgatggcgagggttcttcctatcgtttgataagcaacggatttgaaggcgagtcgaagagtacctggttctctgtctcagccagtgtatccattaagggagaaggcgaagctcgccctcaggattactggtacgactcggctctgttctatgataaattgacgaagacgggaatcggtgccaaggcattggaacgcgtattgcgcaagctgggacagaagaaagcaaagtcgggtaaatatacaatggtggttgaccctatgaatgtgggaaacctgctcagtccgatgctaagtgcattgtatggcagtgctttgcaacaaaagaactccttcctgatggataagctggatacgaaagtggcttccgacctcttcacgttgcgtgacgagccgcatgctatcggtgcaaacggttcacgctatttcgataatgagggtgtggctaccgaaccccgcactgtttttgacaaaggcgtgctgaaaacttatttcatcgatacctacaatggtaagaagatggatatagctcctactatcagtgcaccttcacgtctaattctgacaccgggcgataaggacctgaacggattggttgcagatattaaacaaggcatcttggttacgggcttcaatggcggtaacagcaatagcagtaccggtgacttctcttatggtatagagggtttccttattgaagacggcaagctgacacagcccgtcaacgaaatgaatgtgacgggtaacatggttactttatggaattccttggttgctgtgggcaatgaccctcaaccgaaccgttcatggcagattccttcgctggtatttgagggagtcgacttcagcggattataatgctagttcaacatcaggctcatatatgggcttgatgttgcaaatattttttcggtgagttcaccgattgtaagtgccaagtggctgcccggcagacgcttggcactattcatatatttaccattgttcaggtagtagtagccgttattggcactgacctgctcatcggtgagatgaatgctgagttccagttccggatgggccgtagcatagagttgcagcatggttttggcattgatgatgcgtgccatgcccaaaagttggctttcaccggtagcgggaggagtgagaacccggatggacgggagattcaagctttggcagatatgttgaagcagtaaagtttttgttgcgggagtatccgacacgatttctccaatgcgccagttggctttccctatcggataggtaatggccaaagccgtgatttcctccccattgctcaatgtgcaaacgaagccctgtcccagttgtaaatcggcaatgataacctggaaatcctcttccgtatgctggatgcagcaagggcgctcccgcaatttccggtcgagatattcatatcttttttcagtatattcggcagacatttccaaagtaaggcccgtatcggctgtcggtgtaccggaagcgataaaggtctcttcggcatagcggaatacgggggcataaccgctgcggccatagtagtcgaacagccacggttctgccggtatcagggtggataaggcgacattattgtgtagcatccgtgcaaaggcttgtgataacagctcgtgcattacgccccggttacggtaatcagggtgtgtgcaggcaccggatatataggccgtatgaatatcttctccttcgaacgtcataggataaggcaacatctgtagggcggcaatcacttcttcgccgctttggatggcaatattgatatcattgttgtagcggagccgaaaatacagttcagtaaattcctcgctatcattgaaacagagcttccataagttctttaccttttcccgtatcatcaatcccttatccttttaatccttaatctctaatccttactctcaccatttgatagcttccaccggttcatctttcaggcatgccacgtatttttccagaataatggcaggctgatacgaaagtttggccttgcgcaatccttcaatacccaaatcctcttcacggttgaggtagacatattgttcggggatatggttggcaaattcatagttaatcattgcgtacgctccgtctatgctggtgtcggccttttccacatgtactccgaaggtatcttggttgatgggcattccgaaagtgaaggcggcaattttgccgtctacatgcaggatgcctccggtcaatcccagttcttcaaaattgtggagggcgtagaccagtgcgcgacgttcgttgcccgttccttcatgctggtcgcaattgttggccttacaccattcggcttccaggtccagacattcctggatgcggtcgggagtgatgggagtatattcgtaattataggtgcgtttgaatttgttgacatgattccgtttggactggaatttctttccggcaagcgtggcgaggtctgtacgcagatagaggtaatcggcatagtcccggtctgctgtgaactggaattttccgggcatgaaggcttccagttccgagcacatgcccgaacatattcccagcaggcagaaaggttccccttcccggtgtgcgtcttcgaccagtgcgtccagtacttttgtcaaatctccgttacctatcggcatcatgtacaccagttcgtcgtttgcccagaatttcagcaggaggaagccgtccatgatggcaaactttgtattgtatagaaaacgccagctgcataggttggagaatgagaggtcacaattccgtcgcggactgttctgtgtataggaagtaatcagttctttgtcttgtaattcgatatctttaaatgaaatcatacgttgtttttagttggttatgattatagataacaaaaataagaagattttgttagagtagccctaataatcgcagaatagttggggtcagcaatgcagtgaaaataccgttcagggtcaggccgaggctggcgaatgcgccgtatttgcggctgatgtccatggctgtggaagttcctaccgcgtgggcggcggctcccaaggaaaggccttgtgccataggactgccgatgtgggtcagtttcatggtcttgaagcccagtattcctcccagcaagcctacacagaccactacggcggcggtaagtgagggaatgccgcccagcgacttggttacttccatggctatcggcgtagtgaccgacttgggcgccagggagtagataatctcgtcggaagcccccatcaatttagctatcagcacgacagagataactcccacaatgcagccggcaagttgtgacagcatgatggggagcagctgtttcttaatcgtttccaattggaggtatagggggactcccagggccacaacagcgggtttcagccagaattctatcagatgtcctccttcattgtaggtctcataactgatatgtgtcatcttcaggaagacaatgaggatggcaattgtcagcaggatggggttcagcaacatgatgccggtctttttctgcaggagtttggccagaaagaaaatcccgaaggtgacagccaataggaaaaattcgttttctaaaaagttcatttgattttacgtgttagttgatgaacccatccggtgactacaatcaccagcagggtgctgattatggaagcggtcactatcggccagaactcggaggcgatgacatcgaagtaaagcatgagagctacaccgggcggtacgaagaagaagcccaggttggcaaccaggaagtcggacataccctgcacccagtgcagtttaatccaacccaatttcaagaatagggtgagcaacagcataccgatgatgctggaaggtaacttgatacccgtaaagaaaacaatcagttcacccaaagctaagcatccgaaaaggatggcgcattgacgaatcatattattataatacctattgttatacgttgaaaacgctgcaaaggtaggtattctatgtattgcttgttatcgttgtatcctgattttttttatgtcgtttgtagagtcgggcgggttgttcctgccggacgggtaattgtttgttgcagaggggcacgtgtgcgtacacatgaatgctgggaatacctaatgttaaatattataataattatggtctgaacggtaaaaagaccgatgtttgcaatgtagatattgcaaaattgtgtacttttgcggcgtgaataacacatactgccgattcttaatagacaattaaaatatcatgcaaagattaattaacgaaattgttgagcgtgccaaagcaaaccgccaacgaattgttcttcccgagggtacggaagagcgtacactgaaagctgccaatcaaatcctgactgacggagtagccgacttgattatccttggaaaacctgccgagatagaggcttgtgccaaagagtgggggctgggaaatataaacaaagctaccattatcgacccggaagaccatcctaagaaagaagaatatgcccaactgctttgcgagctccgcaaaaagaaaggcatgaccatcgaagaggctcgcaagttggttgtcgatccgctttatctgggctgcctgattataaagaacggcgacgctgacggccagttggcaggtgcacgcaacactacgggtaatgtacttcgccctgctttgcagattatcaagacttccccgggcatcacttgcgtttcgggtgccatgctgctgctgacacatgctcctgaatatggaaagaacggtatcctggtgatgggtgacgtggctgtgactccggtgcccgatgcagaacaattggcacagattgccgtatgtacggcgcgtacagcccaggcagttgccggtctcgacccgaaagttgccatgctgagcttctctaccaagggctctgccaagcacgaagtggtggataaagtggttgaggcattgaagattgccaaggagatggctcccgatattgccatcgacggtgagttgcaggccgatgcagctttggtgccggaagtaggtgcaagcaaggctccgggttcttctatcgccggacatgctaacgtattggttgtccccagcctcgaagtgggcaacatctcctacaaactggtgcaacgtctgggacatgctgatgccgtaggacctatcctacaaggtatcgcccgtccggtgaacgacctttcacgcggttgctccatcgaggatgtgtatcgcatgattgccatcactgccaatcaggccattgctgccaaaaagaatgctgaataacttttaaatctgatatatagtatgaaaatcttagtattgaactgcggtagctcgtccatcaaatacaaattgtttgatatggaccggaaagaagttatcgcccagggtggtatcgaaaaaattggtttgaaggactctttcctgaagttcaccttgcccagtggcgagaagaaagttcttgagaaggacattccagagcataccgtaggtgtggaatttatcctgaacactttgacaagccctgaatatggagccatcaagtctttggacgaaatcaatgccgtaggtcaccgtatggtgcatggaggcgaaaagttcagcgagtctgtacggctgacgccggaagtgcttgccgccttcactgcctgcaacgacctggctccgctccacaatcctgctaacctgaagggtgtaaatgcaatatctgccattctgcctaatgttccgcagattggtgtgttcgatacggctttccaccagaccatgccgaagcatgcctatctgtatgccgtgccttacgaactttatgaaaagtacggcgtacgccgttatggtttccacggaacctcacaccgctacgtatcgcagcgcgtctgcgagttcctgggtgtagagccggaaggaaagaaaatcatcacttgccacattggcaacggtggttccattactgccatcaaggacggtaagtgtgtagacaccagcatgggcttgaccccgctggaaggtctgatgatgggtacccgcagtggtgatattgatgccggtgccgtttccttcatcatggagaaagagggtctggatgccaacggcatctccaacctgctgaacaagaagagcggtgtgctgggtatcttcggtgaatccagtgacatgcgcgacctggaaaatgccgtagctgccggcaatccgaaggctgttctggctgaagaaatgtacttctaccgcatcaagaaatatatcggtgcctatgccgctgctttgggtggtgtggatatcgtggtatttaccggtggtgtcggcgagaatcaggcaagtgcccgctggggtgcatgtgaaggcctggaattcatgggcataaagctggatgccgagaagaacaaagtacgcggtgaagaaatggttatctctaccgaagattctcaggtgaaggtggtggtaatccccactgacgaggagctgatgattgcttcggacacgatggatattctgaagaagtaatatcgctgtaatatctcccggttccggcttcccggagtccggatgtggtttcgcccctgcaaatatgtaatgtatttgtaggggcgaaatgttttccgaatcctttaaaattgctatctttgttactcggttaaaaacaataaaggcaattttccgaataactttaaataagaactgcttatgaaacgattaatgtatgtgttgttctttgtactgctgaccagcggcatggcctatgcccagcaggcgaagtacgtgttttatttcatcggtgatggaatgggtgtgaaccaggtgaacggtacggagatgtatctggccgaacaagaagggcgcatcggtgtaaagcctttgctgttcacttctttcccggttgccagcatggcgactaccttctctgccaccaactctgtgactgactcttctgctgccggaacagccctggctaccggtgcaaagacctataacggcgccattggtatggacgataacaagagtgtgcttcagagtgtggccgagagagccaaaaagtccggtaagaaagttggggtaactaccagcgtcagtgtagaccatgctactcccgccgcattctatgcccatcagccggaccgtggcatgtattacgagatagccctcgacctgccgaaagccggtttcgacttctatgcaggcggtggtttcttgaaaccgactaccactgccgacaagaaagaggctccgagcatcttccctatctttgaagaagccggttataccgttgcaagaggccttgacgaatataagtcgaagtctgtccaggcagacaagatgattcttatccagaaagaaggtgcagagccttcttgcctgccctatgccatcgaccgccaagaaggcgacttgacgctggccgaaattaccgagagcgccatctctttcctgaccaaaggtagtaacaagggtttcttcctgatggttgaaggtggaaagattgactgggcctgccacggaaacgaccctgccacagcttttgaggaagtggtggatatggataacgccatcaaggtggcttacgagttctataagaagcatcccaaagaaacgctgattgtggtaacagccgaccatgaaaccggtggtctggggctgggtaccggtaagtacgagcttcaactgaaagcccttgccaagcagaagcagtctcaggatatcctttcacgttccatcacggacttacgcaagatgcgcaaggttatcaactggccggaaatgaaggaattcctggcagaaaagatgggtttctggaaggaactgccggtgaactgggagcaggagaagatgctgcgtgatgcttacgaagaatcattcgtaaacaagcatgtagtgtttgaggaaagtctttatgccaagactgagcccctggccgttgccgccaagaaggtaatgagccagattgccatggtaggctggaccagcggtggccatacagccggatatgtgccggtattcgcagtaggtgcaggctccaagctgttcgtgggtaagatggacaacacggaaatcccgaaacgcatagccaaggctggcggatacaaataataaaaagtcaccacagattatgcggaattctcacagattggaagccctgatatcaagtataaggggataatctgtgagaatctgtgtatcagtggtgactgtcaatttattccttaagatccttctttataatttcatccatctctcggatacgtttttcccgttccctggcggattttaccttctggtccttgtatccggtatctgtccgttcggagacctcttcgctccattcctcgaattcatccgttgccggacgtccgtgcgggtctatgttctcttcggcaatcgggtcgtttctgtaaatcatatcatccatgacgctaatgtttttaatgttatgatgttactacaaccatgccgggaaaaagttccggtaaccttcactttttcgtaatcatttataagaataaacgttttatagcgcgggcagcaggtacttccatattagattcagctctgcctgcatgtcggggatgttggcggtgacggcaatgacggcatccttgtccggcaacaccagtatgtattgtccgttggcaccatcggcacggtaggcgttgtggcggcagcgccacatctggtagccgtagccctgcagccagtcgcttgtcttggcgttcatcttcgctttcttcaccatctccggtttcatgccggcgggcagtgagggcacttggcaggcagatgcctcctttacccattcttcgggtagaatctgctttccgttccagtttcctttctgcaggaacagttgccccatcttggcaaggtcttccgttttgaggtacaatccccagcctccggtattgatgccttgcgggctttcctgccaccgggcattgatgatgccaagcgggcggaacagacggggatagagataatccaccactttctcgcccgtcactttctgtacgatggctgagagcatgtaggttcccaggctgttgtaggtgtagaaggtaccgggcttgtgctccacggggaaggcaaggaactcctgcacccaatcggcgtccgcctttttgcgtaccgttccggtagggtcggtgtcgtgcccgcagttcatggtcagcaggtcgcgtacggtcatggctgccaggttttcgctgacggttgccggaagcttgtcggggaagaaggagatgaccttgtccgtcagcttcagcctgccttcggaggcggcaagtcccacggcggtggcggtgaatgtcttgctgacggagttcaggatgtgaggcttatcctctttcccttcgcccatccattcttcggcaatgacattgccgtgttgcacaatcatgatactgtgcaggtcttgtccggctttctttacggcatccagatatctgttcatggccttgtccagcttcggagtagcggcggcgcggggcaggcccttggtcagttggttgatggaaatcagctttatgcctttgtcctcaatggctttccggacgcgggggcttgtcagcaggtcggtcactccctggcggtccagcgccacgtcctcatatccgatgtggaagacggttttcatttcatcgttgtccagtgccgggtggtctaagaaaaggtagcgctggcccggttgcaacttctccaatgctttgatgaagctggcctccttttcttcggcggttcttttggggccgtcgtacccgatgtaggtaaaccggtagtccttggaggagtccatgcggtcgatggacggcaggttgtattctttggcgagccgttgcaccagctcgttcacttccttgctgaaaccggtggagagcatgtgtccggacagatggctgagttgcggaatgcttttcagcgtcgtctctatctgtgcgcggaactcctgctctatctccttgatgtcccatttctgctccatgatggactgtcccggataggcggggttagggaacatcatcgggtagaaatagccgttctcgtccgtcaggctggggcagtgggtcagcggacgccacttcacgttctcccactcgctggtgatgacgaggtgcaggccgacgtccagtcccggattttctttcagcatcttgatggcttctggataccaggctgctacgggcatcacttccacgctgcgggcaatacccgagcggtaggtctggatgcaggcttcgttgacggaatgcagggcaccgagatcgtcaatgcggatgacaagtgtcggggcgccggattgtccccataccggcaatgctcctgctgcgagcaggcatccggcaatcatgtttttcagtcttaaaggtttcatgggtggtaatggtatgatggttaacagtttggaaatgcgggttatagcttcgtctctccctccacaaaattctcaaggaagaggttctcgccgtcaaagacggcgtacgagaagtagtttatccagtcgccgaggatgaggatgcgggcggtactgctcagcattaggtccagttcgatgtggcggtgaccgtagatgaagtagttgatgttgggatggctttttaggtattccttggtgtagagcaccaggtattcgttgttttctcccatgtatgcgggttctttcccgtctatgcgtttcaagcggctgtgcttggcccagttcagtcccagctccatgctccagcgggggtgcagggcagagaacagtgtctgtagggtacggctgcggaacatggcgcgcagcatcttgaacttcttgtccgggtcgcctagcccgtcaccgtgggcaaggtagaactcttttccgaagatttcggtggtcagcggttcgcggtgtatcatgacgccgcactccttggtcagatagtcgccgcaccaaaggtcatggtttcccgtgaaaaagtggacttctactcccaggtcggtcagttcggacagcttgcccagaaagcgggtgtatcctttgggcactacggtacggaattcgtaccagaagtcgaacatgtctcccagcaggtatacggccgatgccttgtgcttgatgctgtccaagaagttgaccagcctccgttcttgggttcgtccgtgttcgatggctcgtgagcccaggtgagcatccgagaggaaatatacattcttcattttcaactttccattttcaactttgaactttcaactgatttaaaggaatcccagctccagtttcgcttcttcgctcatcatgtccttgtcccactcgggttcgaaaacgagattgatggtggcggaggttacgccgtcgatggattccaccttctggcgcacatcttccatgatgaagtcggctgccggacagttgggggcagtcagcgtcatgtcgatggaggcttctccctggtcggagacgtctattttgtaaatcagtcccaggtcgtatacatttaccggtatttccgggtcgaatacggtcttgagcatggagactattttctcttctatttcaaatttggtcatattcgtagggttttatatataggttttcaaagaacaaagctatggaatttaattgaaaatgcaaaggaacgccctccttttcattacttcggggagggtttgacggtgggtgaacatgcttcaccttctgggggaactccctttacccctggggaaactccttttacaatacgcggtaaaggtctttacaatatggggtaaaggacgttacaatatagggtaaatacgtttacatactgtggtaacggcttttacattggctggtaaatagcaggtaaatacaatgtgctgatagttagtgttatgaccgcttttgtctttcgtatagtatgtccgtaacttggattatttatagcaatccttcgtcgttgaagctgtaatggcttccgtccgtgacgatgacgtggtcggtcaggtgtatgttcatggtttgggcggctttcctcacgagttccgtcagccgctggtcgtcgttactggggtgcgggttgccggagggatggttgtggataagggctatctgtgtggcgcgttgcagcagggcttcgcgcaggatgctgcgcacgtcggcggtagtctggtcgatgccgccgcggctgatgcgtaccttgtctatcactttggcggcgtggttcataagcagtacccagaattcttctgtggcaaggtcgcagagcaggggatggaacagctcgtagatgtcggcggaagagcggatggcggtacgtccggagcgttcctgcagcttgcggcgtttgcccagttccagggatgccatgacggtgatgcttttggcggggcccatgcctttgaatcgggagaagtcccgcacctcccatttgcccaggcggttgaggtcgttgccgcaggcggcgagtatgcgctgcatcagtgtcacggcggtttcttccgtattgccggagccgatgaggatggctagcagttcggcatcgctcaaggcttccgcccctttctgcatcatcttttcccgcgggcggtcctctgcagcccactggttgatattcagtttctccatatcatccctaatccttaacccctaatcctccttatttgtaaaaattctttttgaatgcctcgaactcgtccttgccaagtatgcagcggttccaccaggcgcgcaggaaccccgtcccgtatccgatgagctggatgaaggaggcggcgacggagtagagcccgatgctgaggctacggttccggatagtggagtccatgcataccagaagcgcataaagagcgatgggcagcaggctgtacgggcagaagggcgttcccagcaggaatatggccactcccagggtaaatgcagccggcagcaggtggacgagcttcagcgattccggatacttcttgtacagattgatgcgggcaatcccggaattgtgtacctgcttgaagaattttcggaagtctgtccgtcgcttgtggtatacccaggcaccggggaacagccggcatgtatatcctcccttgaagattcggatgctgaagtcgatgtcctccccgaagcgcatccgcgagaatccgcccagggcttggtacacttcctgccgcacacccatgttgaagctgcgcggatagaacttgtccatcttcttcttccccccacggataccgccggtggtgaagaaggaggtcatggagtagttgatggctttctgtatgtttgtgaatgattcgtgcgcgcggtcggggcctccgaaggcatcggcggcttcgtgctgcagctcttcttccacagcaaggaaataaccttcgggcaggatgcagtccgaatccagtattatcaggtattcgcccttgcttcgttccaccccgtagttacgggtctgcccggggccggagttgggcttgtcatagtaatgtacgtccaatagttcctgatacttctctgtgaccggcttgcaggggatggaggagccgtcctccaccacaatcacttcaaaatccttgaaactttgctgcgtcaggctttgcagcagttcatccacctcatcggggcggttgtatacggggatgatgacggagtatctcatgggtatggctttatgttttggttgtctccgcaaagatatatcatttaagctttgcagatgaataaatggaaagaaaaatccccggatgccaagtggagcaccggggatgatatgaaaagggcatttgcctgatttccaaaagggcttatgcttttacgcggcttacgtaagaaccgtcgcgcgtatcgatttcgatagtctcgccttcgttgatgaacaaaggaacgcggaccgttgcacctgattctaccgtagcgggcttcagcgtgttggtggctgtgtcgcctttcagtcccggctccgtataggtaatcttctgctgaaccttgatgggcacgtcggcatagagcacggtttctgtggaagcgtctgataccacgtctactatcattccttcgagcaagaagtcaacaccgttgatgaggtcgtgggcgatgggaatttggtcaaaagtctcctggttcatgaattggtagttgtcaccgtcatgatagaggtattggtggggacgacgttctacacgcacgtcttccagtttctcaccgatgttgaaacggcgttccagaacgtaaccgttcaccacgtctttcagcttagtgcgcatgaaagtattaccttttcccggctttacatgcaggaagtcgatacagaaatacagcttgccgtccatacggatgcaagttccgattttaatgtcttgggcattaatcatacttatagtctttaatattattatattggtatttacttcgttagtgctggtttgcgggtgcaaaagtaatggaattcggtaaaaaacacaaaaacttttgagagaaaatgagttatctcttggtttatttgaaaaaagtacctatttttgcagcccgaattcgtgagaataataacataaaacaagatacagtaatgaaaagaacatttcaaccctcgaacagaaagagaaagaacaaacacggtttccgtgagagaatggctacagcaaacggccgcagagtattggcagcacgtcgtgctaaaggcagaaagaaactgactgtttctgacgaatacaacggagtaaaggcataataggccgttctcgttcgtattaaagaaataagggagctgcaaaagactgattctggtcttttgcagcttttcttatgtattgtgcccggttctccggaaaaaactattgccaactccgtgtactatgtggtgaaaattgtatctttgtcccaaataatgcattatcgattatgacaataaaagattttttctctttccggcagaaccggttcttctgggcgaacatccttgcgatggccgttgtggtagtgggattgctgttcggagtgctgaaaggactggatatatatacccgccacggcgaggctgtgatagtgcccgatgtgaagggtatgggagtggaggaagccgagaaaatgttccgtaaccgcggcttggtctgcatcgtttcggattccagttatgtcaagactcttcctgccggctgcatcctcgaatataatccggcagccggacaaaaggtaaaggaaggacgtaccatctatcttacaatcaatacgattgaagtccctctgcacatagtgcccgatgtggcggacaacagttcgctgcggcaggcggaagcgcgtattctggcttcgggcttcaagctggccgagatacagtatattccgggagagaaggactgggtgtatggcgtgaagtataagggccgtcagctttccatcggcgagaaagtgcccgccggtgcagtgctgacgctgatggtgggagatggaggcgccttgcaggcagactccctgggagtggattctgtgggaggtaccgttgaacccatgttgtccgaagactccgcggcagatgagtcctggttctgataaacatctgactccaatcgtaaattgtaaatagtcaaattgtaaatgccgtgatgatagaagaattgccggatgatatagataatgatgagctggacgacgtagagccggtgggtgacgaggcgcaactctatgaacacttccgtgtggtggtggacaaggggcaggagatgatgcgggtggacaagtatctgttcgaccgcttgacgaactcctcgcgcaatcgcatccagaaggctgccgatgcaggcttcgtgatggcgaacggcaaggctgtgaaaagcagctataaggtgaagccgatggatgtaatcactgtgatgatggaccgtccacgctatgagaatgaagtcatccccgaagacatcccccttgatatagtatatgaggacaagtatctgatggtagtgaacaaacctgccggtctggtggtgcaccccggtcatggcaactatcacggtacgcttgtcaacgccatagcctggcatatgaaggataatcccgattatgatgccaatgacccgcatgtgggactggtgcaccgcatcgacaaggacacctccggcctgctggtgatagccaagactccggatgccaagacgaatctcggcaaccagttcttcaacaagacgacaaaacgccgttaccgggcgctggtctggggaaatgtagagcaggatgaagggaccgttgtcggcaatatcggtcgtaatcccagagaccgcatgcagatgaccgtcctccccgacgaccagggaaagcatgccgtcacccattaccgggtgctcgaacgtttgggatacgtcacactggtggaatgtatccttgaaacgggacgcacccatcaaatccgtgtgcacatgaagcacatcggacacatacttttcaacgacgaacgttacggtggacacgaaatcctgaaaggaacccacttcgctaaatacaaacaatttgtaaacaactgcttcgacacttgtccgcggcaggcattgcatgccatgacgctggggtttgtgcatcccgtcaccggagaagaaatgtacttcacttcggaattgcccgatgacatgacccggctgatagacaaatggagaggctatatcagtaacagagaattagaatgaaacgcacgattgctattgtagccggaggagatacctccgaattccacgtctccctgcgtagtgcacaggggatttactccttcatcgacaaggagaagtataccttatatattgtagaaatgcacggactggactggcatgtacagctgcccgacggcgctaagactccggtagaccgcaatgacttcagcttcgtgctggatggcgagaaagtgacattcgactttgcctatatcaccatccacggaactccgggtgaggacggccgtctgcagggctattttgatatgctccacatcccttattcgtgttgcggagtactggcagcgtcgctcacgtacgataagtttgcctgcaaccagtatctgaaaggtttcggtgtgcgcattgccgaatcgttgttgctgcgcggcggacagtcggtaacggatgaagatgtgatggagaaaatcggtctgccttgcttcattaagcccagcttgggaggttccagcttcggcgtgaccaaggtgacggcgaaagagcagatacaacctgccatagccaaggcatttgcggaagcgcaggaagtactggtggaggcctttatggacggaaccgagattacctgcggctgttacaaaacaaaagacaagtccgtagtgttccccattacggaggtggtgagccacaacgagtacttcgattatgaagctaagtataatggtgcgtctgacgagattactcccgcccgcatctcggacgatttgacccgccgggtgcagacgctgacttctgccatttatgatatactcggggcctacggcattatccgtgtggactatatcattaccgaaggggaaaaaatcaatctgctggaggtgaataccacccccggaatgactgccaccagctttattccccagcaggttcgtgctgccggaatggagatgaaggatgtaatgacagatattatagaaaacaagtttaaggattaatcattattcattatgaatgcgaacgtggaatttgatgaaatccgtccttatcatgatgaggaacttcctcaagtctatgaggaactgattgccgatgcggcgttccggcaggcagtggatactgtgatgcctggtgtaccttttgaagtctggtcgcagaaaatgcgcgcgtgtaaaaccaagctggaatttcagaagaccttctgctatgggcttctgtggaaattggcgaaggaggttacggatggattgactttggaccataccgcgttgccggcagacaagtcggcggcgtatacctatatctccaatcatcgcgacattattctcgattccggtttcttgtccattcttttggtagaccagggtatggatacggtagagatagccattggcgacaacctgcttgtctatccgtggattaagaaattcgtgcgtgtcaacaagtccttcatcgtgctgcgtgcgttgaccatgcgccagatgctggaggcttccgcacgcatgtcccgctatatgcattataccatcagtgagaagaaacagtctatctggattgcacaacgtgaagggcgtgccaaggattccaacgaccgcacgcaggacagtgtgctgaagatgctggcaataggcggtgaaggcgacgtcattgaccgcttaatggaaatgaatatagctccgcttgccatttcctatgaatacgacccttgcgacttcctgaaagcgcaggagttccaactgaaacgggacattgaaggctataagaaaacgacggctgacgacttgctgaatatgcagaccggactgttcggctataaagggcgggtacatttccagacgggtgcctgcatgaatgatgaattggcgaagatggaccgttcacttccgaagcccgaactctttgcacgcatgtctgcactgatagacaaacgcattcatgccagctaccggatgtatcccaataattatgtggcacacgaccttctcgaggggaaggaggatttttccgaccattacactgccgaggataagcagcgcttcacggcctatatagaacaacagttggagcgtatctccattcctaataaggacgtggactttctgcgcggaaaaatgctgctgatgtatgccaacccgttgaagaattatctggcggctataaaagaatgaatacatgaagaagtactgtgattggtggcttttgcctttgttggcctgtctgttggctggttgtggcgatgatgattatcattatccttccgtgaagttggaattcttgactgccttttcgggggctgacggctatctgcggtctgttgtgacggatgaaggggaaaccttgccggtagtggaggacaagacaaagacgaacatagaggcaaacgcttcggtacgtgtcatcagtaattatgcttcggaggtaactgccgatggaactgccggtgcggtgctgtatgccttgagcggtgttctttctgtcgttccccaaacggtcgacaagttcgaggagggcgtcaagacagaccctactgatgtactgggtatctggatgggactcgactatctcaatatgacactgatagtcaaggagaatggtgaacataagttccattttattgaggatgaagtgattgtggatactgctaccgggtgtagtgaagtatatctgacgctgtatcatgacgcaaaggaggaggtggtgtcttataccaggcgtgcctacgcttccgtacctttgcggcagtatgcggcagagggtatacagaaggttatggttcatttcagtgtgcacacttattccggtgacatcaagacttacgattttgtttataaccctgactaaaatgaaatattcgatgaagacattgttcgcgggcctttgcctcgtttttaccaccctcttttcctgccagcagaaggagggacagttcaagtctgtttcggtagatgacttttccacattgatagccaatccggaggtgcagcttctggatgtgcgtactgttgccgaatactcggaaggacacgtgccccacagtatcaatattaatgtattggatgagttgtttgaaacgatggccgactccactctgcagaaggacaaaccggttgcagtatattgtcgtagtggtaagcgtagtaaaaaggccgctgccatactgagcaaaaaaggatatataatctatgaccttgacaaaggtttcatcggttgggaagaagcgggcaaagaagtggaaaagtaatagcggtgtagctgaaatgcatttgctataatttctttttaggcgaggattacgcggatttcacggaaaaatttaagaaaagaatccgcgttttccgcgtaatccgcgcctaaaaagaataaagtagtcttgtcctctggttagaggctttcaagcagtctcttcagcaccactgttgctgaaatctcccggttggccgcttcggggattacgatggactgcgggctttctatcacatcatccgtcacaatcatgttgcgtcgaaccggcaggcagtgcatgaagtaggcattgttggtaacggccatctggcgctcgcctactgtccaggcgcggtctttgctcaatatttgtccatagttgtcgcccgtataggccgcccagttcttggcatagacaaaatcggctccttcaaaagctttcatctggtcatattctacgtgggcatttcctacgaacttggggtcgagctcataaccttcgggatgtgtaatcacgaagtcataatcagttgcattcatccactcggcaaaggagttggggacagcctggggcaatggacgcggatgtggagcccatgtcatcactactttggggcgttccgtcttcttgtattcctcaatggttatcaggtcggcaaaactctgcaacggatgacgtgtggcagcctccatcgagaataccggccggccggaatgcttgatgaactgctccagtatcacttcgttgtaatcgtcttccttattttcgaagcgtgcaaaagaacgtacgccgatgacgtcgcaatagcagcccatcacgggaatggcttccagtaagtgttccggtttgtcaccgtccatgatgacaccacgctctgtctccagtttccaggctccctggttgatgtccagtacaattacgttcatgcccagattcaatgcagccttctgtgtactgaggcgggtacgcaggctggagttgaagaaaatcatcatcagcgttttgttacgtcccagttccacatatttgaaacggtcttttttaatctcgaatgcttcgtccagtgcagacttcaggttaccgatgtcctgcacgcaagtaaagttcttcatatttacagtctttttagtgtatctatatctttgttattcggctgtcaaggtctggtctgtccggaaccttcgacaatccatttgtatgtggtgatttcttccagagccatcggaccgcgggcgtgtagcttctgggtgctgatgccaatctcggcaccgagtccgaattgtgcgccgtcggtgaaagaggtcggtgcattgacgtatacgcaagcggcgtccacttcccggcagaaccattcggcacgtgtcttgtcgtccgtaatgatgcattcgctatgtttggaaccgtacttccggatatgtgccaatgcttcctggaaagaattcacggttttaatggccatcttgtagtccaggaactctctgccgtagcagtcttcagtggcaagtctcaacagctcgacgggatatttgtcacgcagactgtggtaggcgggttcatcggcaaatatctctacattgcttgattgcagcggcaggcataggtcgggcaaattagccaggctgtcggcttcgataatcaggcaatccaaagcgttgcatacactgacccggcgtgtctttgcattggcaatgatagatggacctatgcttatatcgccatagcggtcgaagaacgtatggcatacgccggcacctgtctctataaccggtactgtggcattctggcgtacgaagtttatcaggctgctgctgccgcgcggaattatcaaatctacataatcgttggcatgcagtagttcggcagtcgcctctctgtcggcaggaagcagttccacgatatgtgtatctacgttgaaatgctccagtacctcgtgtatcacgctgattatggcacggttggaatagtctgcatcgcttccgcctttcagaatacaggcattgccgcttttaaggcagagtgagaatacatcgaaactgacgttgggacgggcttcgtagataatgcctatgacaccgaaaggtacactgaccctttttatcttcaatccgttgggtaatacgttctctttaaggacttttcccaaaggagaagggagggcggctacgttgcggatgtccgcaacgatgtcctgcaaacggctttttgtcagtttcaggcggtcgtatttagggtcggtagaaggcatacgctccaaatccttctggttttcactcagaatgaagtctgttttgtttatggcagcgtctgcaacagccagtaatatttggttgatttctttgtcgctcaacgctagcatgttacggctggcatcttgtacggcgacaaaagttttgtttaagttcattttcttactgagtatagagtgataaatatgcaagtatgaatatcgtggatagtatccgtctgtgtcctattctatatataggtagtcgtagtgcactacgggtttctttccatgttttcccattgtttcccgtgcctggctggagtcacagttggcttttcccacaccgatgggtttaccgccgaagtcgataatccgtacgatgtcgtccttctcgaactcgcctataacgtcagtgatgcctaccggtaggatgcttactgctttgtccgagaagagcagttcggtggcacaatgattgatgtgcagttcgcctttggcaaacccttcgctgtgcgcaatccatttcttgatgctcgataccggttccggagacggaatgaaacgggtatagtttaattcttcattattcattattttcacgaggatgttgtcccgcttcccgttggctatgattactgtgatgccctcatccgccactttgcgggcaatgttggtttttgtcagcatgccgccgcgtccgaagctggacttggaagtttgtatgtaggaggagaggtctttgccttgttctatttcacggatgacttgagactccgggtcggcgggtgaaccgttgtagatgccgtctatattgctgagaatgattagtgcctgggcatccatcatggaggctatcaggccggacagttcatcgttgtcggtgaacatcagttcgctcacggagatggtgtcgttctcattgacaataggaatgacgccgttctccagcattacggtcatacagtttttctggttgaggtaatggcggcgggtggaaaagttctctttcattgtgagcacttgtcccacggggatgccatgctcccggaacagctcgtagtagcggttgatgagtttggcctgccctacagcggaaaagagctggcgctggtctacgctgtccaacttcttggtggggtgcacttcactacgtcccgaagcaacggctccggaagaaacaagtattatttctatgccggccttgtgcagctcggctatctggtccaccaaagcggacatgcgggtgacgtcgagagtgccgtcacgacgtgtcaaaacattgctgcctatcttgacagcaattctattgaaatcaatctccattttctctcttttcgtattcgcggactacttccatagcggcttcgtagtccttttcattgacgaggacggaaacatctaccgcagtggcaggcagtacaacgtttactaccattccgtcttttgttacagcttcaatatcactatttcccagcaggctctttacaagttctgcttcccacggtgaaccggtgaacacctcaacgagtttgcttttgtcttcttctttcatgatggtatgaatttagaggtttctgtcttacaaatataacaaatgtttttgttttaatgtttaatgctgacgaatttatagttcaatcctctcaactcttatcgattcattcaggaaagtagaagccgattctgtgaatttctcctccgattccgtggtgcggtagacgcatcttccacctttggtacattttttgtccatttccggatgacggtgaagatagtctttcagactgtctgccaccagttccccttgggtgacggtcgtgatgccgtcgggcatgtattgctgtatcttgggcagcagcagcgggaagtgcgtgcagcctagaatgacggtatctatctgtgtgtctttggccagcaggttgccgatgttcttgcgtatgaagtagtcggtaccctcaccttgtgcctcgttgttttctacgagggatacccatagagggcaggcttcaccgctcactttgatgtcggggaagagtttatgcacttccagcggataggattcagacttgatggttcctgctgtggcaagcactcccacatggcggctttgggttatgttccctatgcattctacggttgggcggattactcccaacacacgacgcattgggtcgaggcggggcaaatcattcatttgtatgttgcgcagggcttttgccgaagctgtattgcatgccaggatgacgagatggcatcccatctcgaacagtttggtgactgcctgcaaggtgaactcatagacaatctcgaatgagcgggtcccgtaaggcgcacgtgcgttgtcgcccaggtaaatgtagtcatattggggaaggacttcccgtatcttgcttaggatggtcagtccgccatatccggaatcgaatattccgatgggaccggctgcagaaggtaatgtctgtttcatgcgttctaaaggctatgtaccatgcaaagataattcaaatttctcagtaatgtataaaaaataagcgcggataaaactatccgcgcttgctttatcataaataattctattatttaatgcccaattgcgttttgactttggcagttacatcaacgctctgtgctcctacgaatggtatcggggtacgggctaagtcgaaaatgtagacaacaccttcagttttgccgacagcttggatggcttcgtccagtttcttatagatgggagccatagcatcttgctgtgctttctgcatactttgataagcttcttgttggaactgttcctgacgttgagccatatcctgcagctctttctgacgtctttctgcaatgtttttcggcagagagtcggcttgtgccaggaattcttggtacttcttttggaattcttcgttggtacgctgcatttcatcctggtattttttagacatggcgtccaagtcagcttgggctttggtaaattcaggcataacagcgattacatcttgagaattcatgtgagcgaatttagcttgcgccatagctcccagcgggagggcgaacataactacgagtagtgcgatttttttaagcataatgtttattatttatttgaatgattattcgttgggggcaaatatagcgcaaactgaacgcaatacaaaataagcaagcttatttttaatcttgaatgcagtctatattctgaaacaaatgtatgaaattaatttgaatatcccagttttgcaagtacttcattgctgacgtcaatacttggcgaggcaaaaatgatacttgatgcggaagcacggtctacaactaccgcatatccgttctgtgtagcaatttcctttacagcattgtatatttcatcttgaatgggttgcatcagactttcacgttttttatacagttcgccttccggaccgaagtatttgcggcgcagctcggctgccgatttctctttagcgacaatctcttcttcctttttgcctctctgtgtttcagaaagggaagcaatctgagactgatagttcttgtacagagtcttggcttcttcggaaatcttttcgacttcactctgccattgtctggaggcttgttccagttgttcattggcacgttcgtaagcaggaatatttttcaggatatattccatgtcaatcaaggcgaacttctgtgcaccggctgttatacttactgcaaacagcgtaaaaaggatcaataaactcttcttcataacgatatttatttaattgacgatggataattgtctatcgtccattgcttagaattcttgtcccaggatgaagtggaactggctaccgccatattgcgaggaacccattattttgtcgaaaccgtaagcccagtcaatccccatcataccaatcatcgggaggaagatacggacaccgacaccggctgaacgtttcaactcgaacgggttgaacttattgacatcatgccatgcattaccggcttccacaaacgttaacgcataaatactggtacttgtttcgagcatcaaaggatatcttaattccagtccgagacgtgtataggcataaccttcagaaccgtatggagtcaatgagctgttctcataaccacggagggcgatactttctgtagcatagctggagtagccggtcataccgtcaccacccacgtcaaacgtttcgaacggagactttttgtatttgttgtagtgtcccagcaaaccgaattctacacgtcccatcagcaccggagtacgtttgacggtaatcgggtccatcaacgggatgtagactttggatttgaatttccacttgtggtattcaatccacttgtgcatcttgttcatgtcttcctggctgctggtgctgtacttgctgtaatcggtaccgtcgaacagagagaaaggcggtgtgatttgtgcagacaacgagaactcggaaccttggcgcggataaatcgggttgtcgatagagctacgggacaaggtcaggttgaggctgaggttattacacttaccgttggtaaccgggaagtactgccagtcactcagaacataacgttggtaagacaactcggctgtgaactggaagtagtcatccggccacttcaaacgcttaccgaacatcactgcaagaccatacatctggatagatttgtccgggtcgtaataattctcgtagttgttgtaattgccgtagttgtacataccgtagccatacataccgctataatagctgttgtaatagctgttcatgtaggctgaattgtaataacggctactgatgtcggtctggcgggaatagaaagccgatacggagaatgcattcgggcgtttaccgccaaaccacgggtcgtagaatgaaacgctgtatgactgatagtatttggcattggtctggccgctgatggtcaatgtctgaccatcgccttgcgggaggataccgcggtagttctcacccggatgcagcaggttggacagagagaagttggtgaacttcagacttaacttaccgataatacccgtttgtccccaaccggcggagaactctacctggtcgttggctttggatacaaggtcataaccgatgtctaccgtgccgtcttccggtctcggctggatgtcgggctggatttgttcggggtcgaagtgtcccatctgctggatttcacgcatggaacgcatcaggtcttcacggctgaagagttcgcccggacgggtacggagttcacggcgtactacgttttcatacaaacggtcgttaccgttgatgctgactttattgatggtagcctggcgaccttcgtagatacgcatttccaggtcgatggagtcgcccacgatgtttacttccaccggttcgaggctgtagaacagataaccgttgttgtagtaaaggttaccgatggcatcgtcatcggtcattgtacgctcttcaagtaacttttggttgtagacatcacccttcttcatctggaggaggaagttcagttgttcggaaggatacagtgtgttacctacccaggttacattgcggagatagtatttctgtccttcctcaatctgcatgaagatgtctaccgtgcggtcatcgtagggcttgatactgtctgtcacgatgatggcgtcacgataacccagttcgttgtatttgtcgataatcagctgtttgtccgcttcgtagttgtcctcaatgaatttcttggtgcggaacagattgagcagcttgcccttttcgtttgttttcttcatcacacgcttcagcttcttggtcgtgagggcctcgttgcctacaatggtgatttgatgtactttcactttctccttcttgtcgatgtcgatgttgacaatcacttcattcttcttttccggatcatcacgttgggtgatgattacatctgcattcttgaagcccttgtcgtcaaaatagcgctttatcaaggtcttggcgcggtccaccagattaggtgtaatctgaccgccctttatcatgccgattctgctttccaggtcttcacgctctgacttcttcacaccgttgtagcgtatgtcggaaacacgcggacgcatggtcagatgaatggtcagccaaatttggtcgccttcaatcttgtctgctgtaatttccacgtcagagaacagaccgtggcgccagtagcgcttacaagcttgtgtaatctcgtcacccggcacggtgatagtctgccctttggatagtccggacaatccgacaattacataatcctcatagttctgggctccttcgaccttaatgtcggctatttcatacttcttgggtgttcccgaatagagtataaccggcttttcggtttcatcggtgttgtttacgtcctgtgctgctgttgtcagtgcgcagccgaaaaggcagacaaacgttacgagtatggagaaaatacgatagtgcatctttttatttactattttacaatttactatttactatttgtgtgtccggtgattaattgatttgctcgctggtcttgccgaacctgcgttcgcgtttctgatagtcacatatggctttgcgtaattcttcttcacggaagtcgggccaataggtatcacagaaataaagttccgaataggcgcattgccagagcatgtagttactaaggcggagctctcctccggtacgtatcagcaggtcggggtcgggcatgaagtgggttgtcagatgacgggatatgagctcactgtcgatttgttcgggtttcagctcacctttctgtaccaggtcggctatttgccgggcagcttccgttatttcccagcgggaagagtagctcaatgccagtaccaggcacattcccgtgttgtgggaggtgtgtgccacgcaagtgttgagccgttgctgtacgttggcaggcagtttttcaatatctcctattacccggaaactgatattgttcttcatgaacgtctcttcctctatggagtcgaagagcaatcccatcaaggcggctacctcgtccgacggacgattccagttctcggtagagaacgtatataaagtaaggtatctgactcctaatttagcggcttcctctgcaatgacgtgcacagtctctgcgccggcctgatgtccatagctgcgttcgtgtccacgctgcttggcccaccgtccgttaccgtccatgataatcgccacgtgctggggtatccggtttagatcgatttcttccttatatgacatcattattattgtatttcgaagcccaatctgttaagacgtccgcgccatacttcattcttggtgccgttaccgccgaatatcacccaaatgaagtcccgtttgtctgccggggccacagttttgtctttcgtcggttccactataatggagtacgcgcctttccctttgaattcctggggtagcaggaacttggtttctgtcttgctccacgcaatgcctgtgatggagttgtagatggcgtcaagttctcctccaaagcaatagaacatgtcgccatagtacataatggcagggttgaccatgccgggacaagatgtgtcgtacaccgtgttagccaggcttgcccagcctttgccgtccaatgagaaccagggtattgtctcttgttcgttggccagcggcattcctgccagaaccaccttctctacaccattgccggtgttggtctgggtggtggatatgttttcggtagggaatcctgccgggacttcctcaagggtaaggttgtcagccgtgttttccgcttcccaattctttccgtctttacagatgttgaaatattgctttccgttgatttccacaatacccgagagccggtcggagaaaccattgatgaggactatgacattgtctcccaatgtagtgacttctgtccaggcgccgccgttggtagagctgaatactcttttgctttctgtaaccatataaagcgcattgttatactctacggcagatgtcagctttacgtctgaggggaggttgctgacattgactttactccagttgtatttatcgggcgcagtcgatgtcttgtaagcagtactgttggaagtgtagacaaatagttcgtctcccagtacaaccgctttttgctgacctaaattgatggtattggagaatatattcccccttttctgcatgtctgtccatacgagtgagtccgggtcttgcaggtgtacattaactttcaatttatattcgcggactgtaacaccgtcggcggcatgtgctttgaacagcatgccggcatcgttattcatggcgggtctcaaatccacggagtccgacatgacgaataccgtgtcggtaggcgagcctgaagttatccaaccggtaacggtcatagtatcaatcagaatacggtcaatgatggtatctgaacctacgggcaatgaatctctgttatagatgagtctattgagctggtcaattgtaaatttgtaatgtttgccatgtatggtatcgataccaaaagcatgtatagtagcatcggagctgaattcataattgtcgtcagagtcaaggcatgaacttagagcaaatgacacaataagaaaactcacaattactgatagaaactttattctcattttgaaagttagtgtttatttacaagttgcaaaaataggaacatttttttctataaacagctttacggggaagttttatataaaattatagataatatccccctttttctcgataaaaaagccctgaaatgaggctattgactgtttcttgaggccgtataatggcgaaaactcctgccgaaagaatactctgttgcaaatggatatccgtcactgatttcgggtgctttgacgccggaatgaagaaggtgcggagcttcttccacaaagatttcgtcccacaatccggcatcaatgaaggattggagcgtttggctgccaccctctaccaaaagggattgtaatccgcgtgtatacagcatttccatgatttcggggagtatattctgccggtagtcgctgactggcagatattctacattcggtagcggagcgtgcgggatttctgtaaaaacgagggtcggcacgctaccgtcaaataggtgaaggctgggggatagcttttgttgccggtccagcacgatacgtaccggtgaacgaccataccaatggcggacattcaggccgggattgtccagttcagccgtacgggtacctactaatatggcactgtgctctgcccgtttcttgtgtaccagcatcgaagtcagcgggctggagaggataaccggtttaccgtccgtgcgggagtaatcgatatatctgtcagaagattccgcccattttagggtgatgtaggggcgtcgcaaagtatggaaagtgatgaacctgcggatgagctgccgacattctgtttccagcactccgacaataacttcacgtccggcatccttcagtttctgtatgcctcggcccgcaaccttagaaaaagggtcccggcacccgatgacgatgcgtggaatctgcttctcgatgatgaggtctgcacaaggaggagttttgccatagtgcgaacacggttccaggctgacatagatggtggaacgtttcagcagggacgtgtctttcacggaacggatggcgttgacctcggcgtgggcttctccacagcgcacatggtatccctcgcctatgattttcccgtcacatactattaccgctcccaccatcgggttgggtgctgtattgcaaagtccgttttgtgccagttggatgcatcgcagcatatatttctcttcttctgaattcatatccttgcttgtcttttggttgaataatcaaaattaatgattacttttgcagcccgaataaaaccggactccgaatgaatgtaaccgtttcacatatccgcagtgctttgcaggagtgctatcctccccgggaggcagccaatctttcccgtattgtctgctgtgaaatgttaggtcagagtcatattgactattacctgggcaaagatatgattttatctccaaaggatgaaaaggaattggaaagcattctttcccgtctgtgcaattttgagcccatacagtatgtgcagggtactgcccgtttcctgggacgtacttttcgggtggctccgggggtgcttattccccgtcccgaaacggaagaactggtggagaggatgctggaggaagtcgctccggcttcccgtattctcgacattggcactggaagtgggtgtattgccgtcactttgtctaaagagttgccggaagcggaagtaactgcttgggatatttccggagaagctcttgccatagccggcgacaataaccgccttttgcagacctccgtacaatttgtacagcgtgatgtcctgacgtatcaaccgactgaggatgagtactttgatgtaatcgtcagtaatccgccttatgttacggaaacagaaaagaaggacatggatccaaatgtcttgaactgggaaccttcgggagctttgtttgttccagacagcgacccgctccgtttctatcggcgtataggtgaactgggacggagcatgctgacggtcggcggccgactctattttgaaatcaaccgggcatttggagaggctgtcgcttcgatgcttcgcaagcaaggctatacgaatgtccgtatccgaaaagatatttccggcaacgaccggtacgtaattgcagaacgatgatagaaataactgaaactgaagctttgaacagagtggcggcatattgctccactgccgagcattgccgggcggagattgcggagaaactgcaacgctggggcattgcctatgatgccatagaccgtatcatcaaccgtctggaacaagagaagtacattgatgaaaagcgcttctgccgtgctttcatcaacgacaaataccgttttgccaaatggggcaagatgaagatagggcaggcgctccagttgaaaaagatatcttcatctgtctattggccctatttgaacgagattgatgaggaggaataccacgccgtcttgcagaaactgctggcggcaaagcgtaaaagcgtccgtgccgaaagtgagtatgagttgaatggcaaactggtgcgttttgccttgagcagggggttcgaaatgaaggatatatgtcgttgcatagaggtttctgaggaaaatgactactccgaatgaaaattatcggctttctcttttttattctcattctgtttccgtatttttgtgccatatttatcatatatagattagttttgctatgaaaactttagaaagattgtttgcagagaagttgctgaagataaaagcgattaaactacaaccggctaacccgttcacttgggcatccggatggaagtctccgttttattgtgataaccgcaaaaccctttcttatccttctctccgtaatttcgtaaagattgaaattacgcgtctgattttggaacgtttcggacaggtggatgccattgccggtgtggcaacgggagctatcccgcaaggtgccttggtggccgatgcattgaacttgccgtttgtatatgtacgctccactccgaaagaccatggactggagaatttgattgaaggtgaacttcgtcccggtatgaaggtggtagtcgtggaagatttgatttctacgggtggaagcagcttaaaggctgtagaagctatccgccgtgacggatgtgaggtcatcggtatggtggctgcctatacttatggtttcccggttgccgaaaaggctttcaaggatgccaaagtgcctttggtgacgctgaccaattacgaggctgtgatggaagtggcactgcgtacgggctatatcgaggaagaagatgtggagactctgaatgaatggcgtaaagaccctgcacattgggaatctggtaaataagaacttatttgtaaaaatgttaatatggataaaagagccattcggatagattctgtccggatagttcttttttctttttgaatacgattgattatgacgaaatttgagagtggagtgaaagttgtaccggcttcacaagaagctgtttatgaaaagctttccaacttgagcaatctggagaaggtgaaagaccgtctgcctgaagacaaagtgaagaacttgagttttgatgcggagagcatgacgatagaggtggctcccgtgggaaagattacgttgcagattgtggagaaggaaccttgcaagtgtatcaagtttgcaacaaccacttcaccgctgcccttcaatctgtggatacagattgtacccgtcaccgaaaccgaatgtaaaatgaaactgaccatcggcatggatataaatccgtttatgaaggccatggtgcagaaacccttgcaggaaggattggagaagatggcagatatgctggcgatgatacaatattaatcattaatcattagaaacaacgtggctcagaaactttgggaaaaatccgttcaggtaaataaggatatcgaacgcttcacggtaggccgtgaccgtgaaatggacctttatttggcaaagcacgatgtgctgggttccatggcgcacatcacaatgctcgaaagcattggcttgttgacgaaggaagaactgcggcaattgctggccgaattgaagaaaatctatgcgatggccgagtgtggagaatttgtgatagaagagggagtggaagacgttcactcacaagtggaacttatgttgacgcgcaacttgggtgatataggtaagaaaatacacagcggacgttcgcgcaacgaccaggtgttgctcgatttgaagctctttacccgtgcagagataaaggaagtggcggaggctgtggaacaattgttccatgtgctgattatgcagagcgaacgctacaaggatgtactgatgccgggttatacacacttgcagatagccatgccgtcttctttcggactttggtttggggcatacgccgagagcctggtggacgatatgatgttccttcaggcagctttcaagatgtgcaaccgcaatcctttgggttctgctgcgggatacggttcctcgttcccgctgaaccgtacgatgactacccgtcttctgggatttgattccctcaactacaacgtagtgtatgcccagatggggcgtggcaagatggagcgtaatgtagctttcgcccttgccagtgtggccggaaccatatcgaaattggcttttgacgcatgtatgttcaacagtcagaacttcggttttgtgaagctgccggacgattgcactaccggctccagcatcatgcctcacaagaagaacccggacgtctttgaactgacgcgtgccaagtgcaacaaactgcaatcccttccccagcagattatgatgatagccaacaatcttccttccggctatttccgtgacttgcagattatcaaagaggtcttcctgcctgcttttcaggaactgaaagactgtctgcagatgacgacttacattatgaatgaaatcaaggtgaacgaacatattcttgatgatgacaagtatctgcttattttcagtgtggaggaagtcaaccgcttggcacgtgaagggatgcctttccgcgatgcctacaagaaggtgggactggatattgaagccggaaacttctcgcacagcaaagaggtgcaccatacccatgaaggcagtatcggaaacctttgcaacgatgaagtctctgccctgatgcagaaagtggtagatggtttcaattttgagaccatgcaagctgcggagaaagagttgctgggcaggtaaaaggttctgcgggttcaagtcccgctgcgagtactgtacttttataaaaaaaaatttggcagaaacgggaaaactgtttatctttgcacccgttctccaaatgcggaaatagctcagttggtagagcataaccttgccaaggttagggtcgcgagttcgagtctcgttttccgctctcttttccctttttaggatgctcgaatggtggaatggtagacacgaaggacttaaaatcctttggccattgcggctgtgcgggttcaagtcccgcttcgagtactctaagggacgaatcgtgtttttcacggttcgtccctttctttttatctccgttacctgttggatatgaatactttatgagaaagaattggttcactcttttaggttcaatatgctcgttatttttgtcgtaaataaatccgtcaggaaacacgagtttttgtagtcttcttcttccttctaatccttgcaactcccacagcccaaacaagttagaacgcattttaaaagcaaaatcaatgaatttatcgaggttcaatatttctgtattcacttttgaaaattcggtctttaaatctctgacttctttctctaatttcgtcataaccttctcgcaaatgctttgttttttcgcatcggtacagagtgcataatttgtttctacttgttccaactctttttctttagctttgatgttcgctttgatagatttggctcgttctctgttttcttggttcatatattcaaatgtgatggtaagttgcatttttaagagttcacttactttgtctgatagggaatacctgtttacttcttcttcaaaggcttcatgtacctttttaatagaactgttgtacttgcatccttttcggctgcaaacataatagcctatatcagtacgtccgaatttctttcgcattttggttgatatgctggcggatagattttttccgcaacatgggcacttgatactacctaataatggggcatattccttgtctatcttttgttcatatccgctatggtttttggataactccccgtttactttcaaaaaaatctctttggaaatcaacggtgggtgattcccttgtacaatatctccttgcaggaatttatgtgccatatagccgcaataaaaagggttcttgaataattcagataacttttgtttgcagatgtgtagcccttctgcttccaatctgtgtctgatttcttcattggataacttgttatttgctttccaaagaaatgctttccgaatcaacttaccttcttcgttgatagttataatttgctccttcttggtcgttttttggtcatatcctctaggggctttcccaatccatcttccttttaataacgcttttacgctgttttcaatagtagttgctcgcttttcgtcattctgaaaccttgcatttgcaagttccatgagttgcatatactttcctactggggtgcgtgggtcatagttggaagttgcagatactacgtatgctcctctcgcctcaacctcttcaatgatagtcgtacttcccgttctgctgaaacgggaggtactaaatactattactgttttgactggttggctgctacctttcttattgctctgtttgatgaaagcaagcatacggttaaactccttgcgttctttgtcgcttttggcactttcatacgtgccgccaaattcaccaacgatagtgtatgaacgtactttggcatactctctgcatttgtcaatttgtacttcaaggctttgcccatcaacttgctcgcttgaactaacacgagtataaatgatggcattaccgcctatctgttctttttgttgctttttgcctttggcaaaaccttttaaatcaaaattctccatattgcgtattttttttagtatatgcttcatagctcaatacagaaaaagcatatagtgtatcaattaattctttggtctcttcttgggttattcctttgaagttacggttttctttgattgtatctatgtttaaatgctgtgcatccatattgtgttttcattacaaaattgattattattagaataaagagaaaaagtaagtgaatgtcagattgtttattagcaatattttgcattttactactccgcattccgcatttccgcactctctatttcattgcttccatttgcttgctcgttgatagctttttgctttgtataatattcttcatattcatctatccatttttttatggtcttatcgctgatgcccgtcattttggcaacctttctataactcttatgctctttgtagagttgatataccttttctttttcgggggtaatattaccagttcctttaatcaaatctttttctcttgcatatccttcttccttgaagtatagaaagttatcttctcctttttcaatggagcagaccaatacgtgttcttcgtttaatatgatttggctacttctgttctttagctgttttatgtatcgtttttcgttaccatctgtttttgcttgccctacgcaaaaacaactgtcaatgaagtttccaacattcttagaccctgctaaattgtctaaagtaatcggagaattgtcttttttcttgggtgaatgtcctagtagtaagaaacttgctcctaagctattcatgaatgtgcgtagttcgagaataaaggtagccgcttcatttgctttggatagattggggtgcaaacaagtgatattgtctataatgaatagtttaattcctttttttgttacagcttcttcgattctcattcttaggtaggctctgcgttctttgaaatttttagccatatcaaaatcaagattagggcgatagatattctgagggaatttgcaggggattgtgccatcttcgtttgtatatctatcacagatttgttgaatgttcaattcataatcaaaatatagaattggttgtttctgagctacatgtttggctatctgcattgcataaatgctctttccacaattacttgcaccaaataaaacacatagttcattttcgtaccaaaggtttttgtatagtggctctcgctttggctgcttcataccttcggcaataacatcattcattgtggtgtattcaaaactgtcttcattgaaagtatttcttaaattaatcattatcgtaatttttttatggttatacataatgtctttggtaccttttgacattgcaaagttatggtcagtggacgacttggtaactattattttttaatttgaaatgtaatattcttaaaatcagtggattattcgcaaaatggggattttagaggggatttttttgcaaaaaataggggattttgattaagcagtgctatatttgtagtgttaatactaaaggatataactatgttaaaatacacataccatcttgaatattatattggtagtgctccgcataataagcatgagggcttttatagttgcaatgaattattggaaaaagaaatagtactaacagaaaaagatgttcgttgtctccgcataactccattaacgagattggcttctttccttgttggaagtgcatatttggctacagatgaacttcgccaactgtgttatatatatgatggtgaatatcaaatttatgtaagagttatagaaaggtatgataacatgtttgaactcagtgattctctttctaatgacttatacttatttataaataggatttctaaagcgatacttttttttgaaaaagcagatttgacagtaggagatatagttgaaataggtgatagccttaaaaataaactattgtcattagatttgtttagtaattatttgttgattgaagcggaagtggatttcctaattcatattgataggttatcttcgctaaagtattgtaaagcaatagtgcaggaaattatatctataatcaatgaagatgtgatgttggcttataataaagtcgaatatgttagattggatgaacgacataaacaattatttgatattgtccaatcttctattgaaggtataaatggtgtgctatataaaatgacaactttatttggtttttcttatcaatatactccttatgtttcattacgtactttttttaatcgtatattagagtatttagatttggaaataggaatttcagatacttcaaaccaaaaggttgaaattctgcaaaataatatagaagagaatagtaaacaagaattgttggagaaattatgtcctgtttataaaaatcgtaaggaattagaaactattcttgatgaaatagatgaacattatcatattgaagcttgctctaaattggataaagtggctattattcttttattaagagaacattgtaattttctaaatcaaaatattgcaaagaagtttaatcaattaagaaaacttgttttgcagtactacggtttttcggatgtgtcatataaagaaaatgattgtaaggaaaagaggatagaattgtatggttattatccaatgttttgggagaaaatgaaaaatagaaattctcgttattgttagttggcgaaaagttttaacattatccttttttcccccgatttccctttttagctaacaatatgcctttgcgtattatacattttgaattttgatatggtttgtcaaagttcaatccataattacgtaatgctccgtatgttatccctacttgttcggaggtaaaaaattcatatatattggcaatggaaccaaaatagtgatgttcttcgtttatttgcacatgaataacggttcgttcctttttctccttttcttccatgatagatacaatatttactgcaaaaataagaatagtatgccataaaatgaatatatgtcattgcctttaactatttctagcgtaaataaattgcatgtattgaatatatgtcatatatttgtagcgtaattaaaacgaaggaagtatgaaacgatataataaacaacaagtaatgaaagatgcccacagactttacaacaatgattttcaacgcaaggggcgcacatggtcggagtgtctaagagcggcttggagttgggaaaaagatgctgttcaggttcgtgaagagaaagcggcaagacttgatgctatgattgctgcaagttgggctgcgcacaacgaaagaaaagaagccaagacaaatgagaattggtataaaggaattgattcagaaactctttcttatgtaatgggatatggaagaggcaacaatttttattgtggtgactaattaaaagagtattaatcaattaataataaaaaaatgcaagcaataattttaaatggtattacagccacaagagcaagagttattacagtgcgcacgaatgcacgtgaaatagatgggatttccaaagctgttttggttgaacaactgaaagaaaaattgaaaagtggaaaaattgtcaaattcgcctatttgaaaagcaatggtgaagttcgtgtggcatttggtacaaccaatcccgattttgtgaaagataaagtttgtgggtggggcgaaagtcgtgaaagttatgccactactgcgtatttcgacttagaaaaatgcggttggcgttccttccgatgggagaacttaatagcggtattttaatattcacttctataattactgaatattaattgattatcaatgatttactaattagagtattcatggcacattcaaaagtcatgaatatcaactaaaaatgaatattatgagtttgaaaaatagttatgttacttcggattatttagaatgggactctatgctgtccctagttcgcaaactatatcgagaccaggaatatagattgtcgctgttaattggctgtggtagtttcttcggattgcgtataagtgacttgcttactcttacatggtctatgctgttggataatgagaagtttgttatcactgaacagaaaactggcaagcgtagggagattagagttaattgtaattttcaaaagcatattgcagactgttataagtctcttggtgtagtggataaaaatgaaaagtgttttctcagtagaaagagaactgtgtatagtacacagcgaatcaatgtgctttttaagtcaatgaaatcaaagtataatttgaaaatcgagcattttagtacgcatagtatgcgtaaaacttttgggcggcaggtagttgaggcagcaggggaaaactcagaatttgcattgataaagttgtcagagctatttaatcacgctgatatacagactactcgtcgatatttgggactacgttcgcaagaactgttagaaacttatgatatgttgaacttttagaatccaaatccaatattgagataaaatcctaaatcttttgttttattagaataagaaagaaaaccttctattggacccaatggactttcatagccatatccaacacttattccgtatattggttttccatgaaagaagtttgataggtgattttctgaaatggcgtaattacctgcaagagtcagatgctgtttcttttgaaatgtgtgttgaattttgatttgcagacctccgaatgcgttattgatattttctgtgtgtataagccctgagaatggtatttgctgctcaaaatctaaactatatccttcaccacctatcatgttgctgtatattagtggagtgttagtattaaaaagaagtcttccatatattgatggtatacaatatgtgctataacttatggggaatattttctttatctgagtatcaaatgctgaatagtttgcggaagagtggcagttggtatatattgtatatccaatgtgacaatctaaaccttttgttggaaaatattttttgttaatagtttcgtatttcaattctacattgtaatttaggaataagtcatagttcttcggatatgaaaattcttgatttactaatgtcctgaaaaagcgttgataatctaatgatatattagctttaaataatagattgtctaatggtattattgaatatgccaatttactggtattctgtataaaacttggattagcaatcttttgtccattcctgtatagaaaaatgtcattataagcgattttattgatgatgtttatttcctgtatctttgataatgggaggctatattgagcattaagaaaagattgtttaccgcctcttaaagttatttctgcttttcctgtttttaggttttgcaaattcacatttaataagattgccgcaatattttcgctgtcaaatcttaatgcaactcttaattggtcgttttttatagaggtatattgagggctaaatggtaactgaaatgaagtggtatgcggtttttttaaaggtactcttccaactttatctttgattgattgtaaagaagcataatttgttcttgctgcattctctcctcttatgataagggtatcaatcgcttcattcgaaaaacttgctgcattatatccttttacattaactttaatgtaagcatcaacttgtttgattttgtcaatatctaattcggattgacatatcattagcattaactgattgacaacatcaggtacagcctgtaatttatcacttgttgccaattctgattgtgcatcaattgcaatgattatatctgctcccatgcttttagcaacgtcaatgggtaggttatctttgaatcctccatctattagaaccttcttgtctgaatatagtggagtaaaaacgacggggatagccatactagctcgcattgcctctgaaagtttgcctgaccgaataacttctttctgatttgttgccatatctgtagcgatacatgcaaaaggaattggaagactatcgaaattagttgtatcattatagccttctgtgagttgctgcaataactgtgatatatttctgcccctgattatacctccgctcttttcattatttttaatgggtaatgatatgagatatttgctgtcatccaatttgaaaggaaatggtattgcatcacgtgaaattttatcagtaagtaggtcaatccaatttgtttgctttactattatttctagctgttcagatgtatatccaatagaatatagtccacctacaattgcaccgatacttgttcctgcgacatagtcaataggaattcccaattcttctataacttttaaagctccgatgtgtgctactccttttgcaccaccaccactcaatacaattgctacttttttacgtggtagtgcatgtattactaggagtggggtgcaaaataagagtaataccagaatacatcttttcattgctaacagtgtggatttatttgttagctaggggattataattagggtaagtaaacgctaacttacctgtaagattgtatattgttcctccattgggtgaatttgtccatgataaattattaaatgacagtataatacctttttctttgtatacttcttcaactgttatttctcctgttatatttttaggctgatatttgagaaagtcgtcttttgaacctgcaaaaaatcctcctaccatcgttaacttatctccttttttaatatctttttgaggtgaaacctttatgtttaaaatatatctatatgttttatttgacgaatttttatcaaaaagaattgcgtcaaattccgttccatctgcattgcattcagagcatccagtttccttataagtggttgagaatgtgcgtgcattttcactgctaaaagcctttatgtgaatacttctgtccgttgaaaactctgtgtcaacaggattgttgtctggagaagaatcatcattactttcacaactgtacataaataggctagccgccattaaaatgaagaatagaatttttttcatgatttttttaattaaaagttgaatacttgttatttaattgagattgcaaagataatacacgtacatgtacgctcaaaacttttctgcgataatctttcctttaccaattaaaatgattggtatatgactaaaatagaagaatttgtaatacagaaagtgaaggctatgagagtggaacgaaggtggtctcagatggaattggcagattatatgaatatgtctgcaagtttcattgctgatattgagaatcctaagcgcagggcaaagtataatctaaaccatttgaatgtacttgctaaagtctttgattgttcccctagagatttcttacctgatgttccaatagaagaagaggcctgaacttgataaatatgaaagttgcaattttgcatgttaggggtgttgatacctataatattcactaatcttggaagtgaatattatatttgttgttaagttgttgattattagatggaaatagtttttgtttcatggcgatagatatatatgctttcactcttatgtcttttgccatgtttttgaatattgtttttatgtgcggaagtgcggaggtgcggagtgaaatatagtaattgctatttctgattccgcactccgcatatccgaagttaatgtttaattttcgctatattgtttttttgaactacgtttttttaaaagatttttctctgtatttgaattagttaccctagaaaatagccgttggcaggggtggttgttatacccttctgataagaggtctgtccaatctattgcttttccgtctttttcaaacctgataagactgttgagggtataaccaaaaagttttgctaggaatttttcatcagctaaagaatagaatgataattcatacctggttttcacgatataatctttgatttcttcattgttgagatgaacttctaaacgatgcaattttgaaggattgttatagtagttatttatgtacgctttatccgagctattgattatttcagctttcttgttgtatgctataagggtactacctttgctcttatcttttatagcttttttttgtttaatgttgacggttaagtatttatctttatccatattcccactgaaagtatatgtgatttcggggcggtcttctttgcgattggtgattctttttccgttcagaagcgttgttatttgtgggtttcggataagttttcgtatcagtcgggctatgtcgtttgacatatcaagacataggtctagggttgttatattatgtaattctagccctaaattgctttcaataaaatctaaatagtatatctcatcgctgtataatacacgattggaaatattaatccatgcttttttatatccgttttggtgggtattgctttcttctttattgtcattgatgcccaaacgtagttctccaaacaatttatcttttcccatgtcgttataacgtatctcataaacaaacttgaagtgtttcccttctattcgtcttagatagaagtacagaaaatcaatttcttctccaatctctttgtcttttatgacattgatattgttgggttctgtcacttcgtaacagagcctcaacgcatctatatttaaaccgtatattttattcatgttcttcattcttattttcattattaggttggttgggtactgttgcccaatactttttcagtccgttagatatagcttgggtgtgagtggctgattttgttctgcctcttagactttggctaatcttttgtttggttgtatcattcagttgtcgatactgtcttttgtagttgttattatccatagttcatttgttttatacatatataaatatgtggtttagtaggaaagtaaagtctaataggctgaattttcaaaaaaaatatctggaaattttttatggatgcctaaccgttagggctttatcatgcctactaaaatactactaatggagtgttgggttacggtgctgatgcttgtttatcagtttgttatggttgtgttctgtaatattattgatgttgttatccttattactgtacttgctaaaaactctctaatattttgcaaatttcttattatttgctacttttgtaccatactgtaatagcaaatagctctttgagtaactggatatatggatttcgactttagattgcatcttcaatctattgtcaggattgcccaagaacacgttgtttcactttgtttaagaagtatgtttgtcttcttgctgtgtctcaacttatgttgttctgtgtctatctcgtttgatgccattgtgtataacagcacatcacatcctttagagacagtggtaacaagccattttaatgatagagaggacgggcagccgagcgattttcttaaaaaactaaaaaagttgctttggtcaaaaaaatgcttacctttgggtgagaagactattgtagaatctttaaaaattaaggaaatgaaagaaatccaaaaaatgtaatcccaagcgccaaagattttagcttaaggattgaacttaagtttgcgctcgactttagattgcatcttcaatctattgtcaggattgcccaagaacacgttgtttcactttgtttaagaagtatgtttgtcttcttgctgtgtctcaacttatgttgttctgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccaagaacacgttgtttcactttgtttaagaagtatgtttgtcttcttgctgtgtctcaacttatgttgttctgtgtgtctatattgtaaggtgctgttatacgaacatctgtttttctaaaggtctttgcaactcaggtttaaattaacaaaaatgaatcttcttaacaaaatatcctcggtagaaagtttacgtttggcatgggctaaattggaaaaatttaataaagaatctcatggactaacgggtgagactattgcagagtttgaacttaataaagaggataaaattttatccatctccaaacgacttcaagaaggaacatatcaattttctccatatcgtgctgtgcttattcctaaaagtaaagggaaatttcgtcctcttcaaattccagaagtttctgatagagttgtaataaaagcaattgcaatagaattggaagaacattttaaagaacttttagagaaaagtagagggctaagttttgcatatcaaaaaggattgggggttaaagaagctgttgaaaaaataaacgaatattgtcagaatggttattcttatgtgttggaagctgatttaattaatttttttggtactgttgataaagattctcttcttaacgatgttgtttttaagagattgtctgatactactataaatactcttattcagcaagctttaaatcaaagtattgggaatttggattcatttaatgttgaacaaaaaaaatattttgaaaatatagataaagggattccacaaggaaatgccttgtctcctttattatctaatatatttctttctccttttgatttgaggttacaagataaaggattcaagttggttcggtacgctgatgattttgttataatgtgtacttctgaaaaagagtgtgaagaagcatatatagagtgttgtactgttttagaagaacttaatttgaatattcataagttggaggaaggaggcaagacaagaatcgtgaattttaataaacatgatactatggatttcttatctgttacttttgatgggaatatgttctatccttcttttgcgaatgtagaacggttgaagaataaaattagagatgtttgtaatggcaaagataaatattgtgtttcaaccttattaattaaaataaagaataaattggatggttgggtatctgcgttttattatacagatatacagagatattcttctgaaatagatgcttttataaatagacaactttatttatctcttgcaaaaatgggttggaagtttacggcttcatctttaggaaagttgccgcataaatttagacataagaatgaaagtcccaaatgtctttcttttttgcaaagaaaaaattctggcattccactttgtatggaattggtaaatgcaaaaatcacggaattgaagaaggcagagaaataaaaaggggaaataatatttagcataacaaagaaaacgccaattacaatatagtagttggcgttatattgtttatagtcccccaatgagtttcgtgattgaagaattagattgcagataatctactatttctagaaaatcattccaaaggttcaatatttcatccgttaagggtactcgattaagctctgtgaatcattgatttgcagagctttttctttataagctcttgatatgaaagaccgtttccctatagcgaacaaagtgtttcccttaatagaacaagttgtttcattatggcgaacactttgtttcccttaacagaacatttcgtttcatcatatgaaaacagactgtttttccttattggaacaaactgtttctctatacttgaacaaagtgttcatctctgtgaactaacaaactaactataatactatagtagatgatatgcgcgtggcacttggtaatatgtgcttgcagatgaaataaaagaatctatataaatagcctcctctttattgttcagaacagcttggggcgtttgttattgaaccgatagccgatacccaacatcagataattgggctcatgaaattcccggaggttatatcctatatggagatacgaattgcgtgttacgtctattttcagggcaagaatctgatagaaagacttcatgtcaccgccgccgtgcagaacattggctcccagaccgatacctaccgtgaagtaaggcatgacaaattctccgcgggcggataagcccaatgccatctgtttcttggcgggcggagtatagaagccgttctcttcttcgtacgattctttcatgttcgcactgtggtcgtatacgccgtccaacgccacaccggcgcggaatttatagtcgaagttgtacatgggtgcaaagctgaaaccgaacacgttgtaagtgccgggtgcgggtacctggccactactgccctcatgggccactgctttctttcgccaggagccgaacaaagtcaggtcgtagctgacgtggcgggggaatggaggaacgatagggcgttgccatgattgggcgagctcatccgctctgcggttaaagttatataccaaccccactttgcagtccaccgtgttcagaccggagttgggatattgggtatttccgttggaaaagtggcttccggtagttcctatcatcaggtcgaacttgggggagagtgcccactttaagtagaggttcacattgagataggcattcactttcgagccgataatctggttctccgggttgtcatattcatcgtagggtttccagccgaacgatgcgccgaagttccattcatagttcaaggatatgcgggggctgaattgggcgatgcgtcccccttgaaacagatagaccgccagcgggttgcccagctcttccggattgccgaagttgaaatagccgactccaatcccttgataggctcctatataagcctggtcggcaacggtgtggggacggagctggaaggagtatttcagatggccggcataggcatttttcatggccttgtattggtggttggagtactccagaaaagggctggtctgaaaaatatagccagcacgcccttctacgcctaatctgtggatgaagcgctgtgagaaagggagtgtatcccgtttgtattccgaatgactatcggatgtccattgttgggcgtatattgtatcagacaagaaaagtaccgctcctaagaaagccagtattttccatatctgcattctatttttcatatgccgtgtcggtctttcttgtttataaatgttccaagtgaagtttaatttcgtgcaaatatagttcttttctccttttggtattcacaatgagacaactatttgtaaaaagagggggtaaaacggaaatcgtcaatagaatggccgacttcggttttatcccctccttattcattcacccggatgttgtcttatgattcagatactgggtggcgagtattatttccggtcgttctcccggatttccacacggcggattttcccgctgatggttttggggagctcatcaacaaattcgatgacacgcgggtatttgtagggagccgtcactttcttcacatggttctgcaactccttgacaagctcttctccggtgcgtgccttgtactcttttgccaacacaatcgtagcttttaccacttgaccgcggatttcatcgggcacaccggtaatggcacattccactacggctgggtgggtcatcaatgcactttccacttcgaacgggccgatgcgataaccgctacttttgataacgtcgtcggcgcggcccacgaaccagaggtagccgtcttcgtccttccaggctacgtctcccgtgtagtaaatgccgttgttccatgcctcgtgggtacggttggcatcgcggtagtattccttgaacaatcccagcggtttgcctttgtcggtacggattacaatctgtccctgctcaccggcttccacagaacggccgtcgttgtctatcaggtctacgtcgtattgcggattgggcaatcccatgctgccgggtttcggttccatccagggcatggtggcgacggtgagggtcgtttcggtctgtccgaaaccctccatcaacttgatgcccgtcagtttcttgaaggtctcgaatacagcggggttcaaggcttctccggcgatggtgcagtattccaggctggataggtcgtacttcgtaaggtcttcgtgaatgaggaaccggaagatggtgggcggtgcacaaagcgacgtgacgtgataatcctgtatcttctccagtatggctgcgggagtgaacttctcgtggtcgtatacaaatacgttggcaccggcaatccattgtccgtagagcttgccccacacggcttttccccaaccggtgtcggcaatggtgaggtgtaggctgctctctttcaggttgtgccagaagctgccggtgacgatatgtcccaacggataggtgaagtcgtgggccaccattttgggctctccggtagtaccgctggtgaagtacatcagggagatgtcatcgttcgtgttcggatgttccggtttcacgaaaggagcggcggcctcgatacctttgtggaagtcttcgaatccttcgggagcttccggcccgacgcttacgaggcgtttcacagaaggagactctggcatagctgccgtgatatggtcggtgatgacgctttcgccggcacagactatcattttaatgtctgcggcgttgcagcggtatacgatgtctttcttcgtcagcaggtgggtggcgggaatcaccactgcaccgagtttgtgcagtgccacaatgctgaaccagaattcataacggcgtttcagtatcagcatcaccatgtctccgtgcccgatgccgaggctttggaaataggaagccgtcatgtctgtgtaccgtttcatgtcggcaaaggtaaactgccggcattcgccctggtcattggtccacaacagtgcgggtttgtcgggctgctcggctgcccaggcatccactacgtcgtagccgaagttgaaattctccggtacgtttatcttcaagttcttgatgaagtcctcctgtgaggtgaaggatgtttgagataaaaatctttctaccataactttattacatgattactgccaggaattttacagtctttccgtcaagcgccttcatgccgtgcggcagtttggagttgaagtatagactgtctccttcgtttaagattaagtctttgccgtcgatgctgaccatcatacggccttccagtacgaggttgaactcctgaccggtatggctgttgtaatgtatcggctcgctgtccggtttcggttctacggtcacgatgaacgggtctgccgtgcggttgatgaaaccggctgccagcgattggtatttatatgccttggtacgttctatactggttccttttccggcacgtgtcaggaagtaggagctcattttgggctcttgcccaaacatcagtgcgtccagtgatatgccgtagtgccgtgctatcttctgcagcatgctgaccgagatgtcgaattctccggtttcggccagacggtactcttctgcagagatgtcgcagtcgcgggcgatatcgtcggcagtcagttccaatacgtcacgcagtccgcgcaggcgttcggctatttgtctgatttgttcgtccataattatatttttttaatgggttgttattaaagtgtggcaatgtgccaataggctgcacaatgtttaattataccgtagctcataggcatatcgggacatcgttacattagcacattaaatatcatttactcgctttgatggctttaatcacagtggaggtgaatccttcatgttccagctcgttgattcccttgatggtaattcctccgggggtacacaccttgtcaatctcaacactggggtgcgtgtcgttgttcagaatcagctcggctgcccctttcacggattgtgccaccatgcgcatgccgtctttgggatagatacccatttcaacgccggcctgcatggctgcctggatatacttaagcacgtaggcgatgccgcaggaagtcatggcagtggttgccgcaatcttttcttcgggaatgagcatggcgagtcccatctggttgaaaatgtccagcatcagttgctcctgctccttggtggcattgcggctggcgatgagtgtcatgctttccatctcgctgatggcggtattgggaataagacggaacatggtcatttctttgtctgctacatagtgtgtcagctcttcaaaaggaatgccggctgcaacggatataagaatctctgtgccttttagttccagttcctttatcactggctccatcagccatggcttcacggcaaagattatcatatctgcaccggctgccgcttcctggttgtcattggtcacttgcaatgcggggaattctgccttcagcttgtccagcttgccctgggtggggttggagacaatgatgttaccggcagggatgattgttccttttgccagccctcgggcaatggctccccccatatttcctgcaccgataattgctgttttcatatctttttgttgttaaaagagttgttttgctggcaaaggtagataaattttctacaaaaaacgaccgagagagaaaggtattctgcttttcggtcgtttcttttgctggctgattatttgtgtcaaatattaaagtactttcttgaagcgttccaagaattcctttgcttcatccatgccgaggcacagaggcggcagcaggcgaagtacattcgtaccgcttacaccggtgaatacatgctgctctttcagtagtcttaggcgcagttccttgatgggttcttcaaattccagccctatcatgagtccgcgtccgcgaacgtccttgatttgagggaatttctttagttccgttatcaggaagttgccgacttgggctgcattctctatcaggttttcctgctctatcacatccagcacggcaagggcggcactgcaagccaggtggtttccgccgaaagtggttccaagttgcccgtatactggtgtaaacattgggctgatgagtacgcctgccatcgggaaaccattgccgatgccttttgccacggtgatgatgtcggctttgatgccgttgtactgatgggcgaagaacttgccgctgcgtccgtagccgctttggatttcatcgagaatcaagaccgtgttgtgttccgtacaagtctggcggagagcctgcatgaattcgtctgtcggcagttggatgccgcctacaccttgtatgccttcgataatcactgcgcagacatctcctttggacaattcggccttcatggcttcgatgtcgttcaacgggaggtaggtgacgtgcccgcagttgttgatgggagcgatgattttaggattgttcgttacttccaccgccagtgaggtacgtccgtggaatgcttttgagaaggatatcacacgggtacggccattgtagaaagaggcgagtttcaaggcgttttcattggcttcggcaccgctgttgatgaggaagaatgagtagtcgtcatagccacagacttttcccaagcgttctgccacttgctgttgcagcttgttaattactgagtttgagtagaatcctaacgtagcaacttggttactcaccatctctacataatgtggatgtgcatgtccgattgagatgactgcatggccaccgtagaggtcgaggtattcggtaccgttctcgtcccatacatggcagccttttcctttgacgatgttgatgtcaaagagagggtatacgtcgaataaattcattttttttagaatgcagaaggtttcaaccgtaatcctacggtctcttccaggttaaacattaaattcatgttgtggactgcttgtccgctggcacctttcaggaggttgtcgatgcaggaaatgataagcagcttgtcaccgtgcttctccaggtggatgaggcatttattggtattcaccacttgtttcaggtcaatgttcttttccacgacaaatgtaaaggaatctttggcgtagtattcttcgtacatacggatgatttcttccagagccactttggtctttactacgatggtagtgaagataccgcgcgggaagtcaccccggtaggggataaaatctatttctgcatcgaaactgttttgcagctggcggagtgattgcttgatttcgggcacgtgctggtgctcgaaagctttgtaaacactcatgttgttgttgcgccagctgaagtggctcgtggcacccggtttcactccggcacccgtacttccggtgatggcattcaccatgatgtcatcattcagcatcaggtgcttggcgagcggcagcagccccaattgtatgcaggtggcaaagcagcccggattggctacatgctttgccttgcaggtggcgcggcggttcagttccggcaagccgtaaatgaagtcgtggtcaggagaggctatgcggtagtccatggagaggtcgatgattctcaactcctcgggcacgttgtggctttcgaggaattttctcgtgtcgccatgtgccgtacagaaaaacagcacgtcgatttcttccaacggaagctggtcggtaaataccaaatctgtttcaccgtacagtccttcgtgtacatcagtaattttgttgccggcgttgcttgaactgtttatgaatacgatttccgcttccggatggttgagcagtaaacgtatcagttcgcctgccgtgtatccggctccgccgatgattcctactttaatcatttctataatatctattggattcttctggtatgataatcaataatataatgtatataattacacctgcaaaagcagtaaagacggtagcgaacgtataaacgatgcgtactaaagatacgtcaagtccgaaaaaaattgccagtcctgcacatacaccggaaagtattcttccggttcggggacgtgtcagtttccgtttcttgtccgtcatttagattttctcgtctttgtgatttgaataatatgcacgcagtgccgtggaggttactttgatgaatcccttggcatcttctgccgtccagcctttctgcatttcgccgtattcgccgaacttgtttttcacaaggtcgtccttgctttctacacctacggtagagaagcagagtgggtgaagctcgaggatagccgtaccgtttacgttgcgttgcgaggattccagcatggcttcgatgtcgcgcattaccggttccagatattggctttcgtgcaggaacatgccgtaccagttggctacctggtccttccagtattgctgccatttgctcaaggtatatttctccaggaacttgtgtgcgccgataatcagcatgggtgcggcagcttcgaagcctacacggcctttgataccgataatcgtgtcgcctacgtgcatgtcgcggccgatgccgtatgctgcaccgatctcttccactttctggatggctttgatgggatcgtcgaatgtctcgtcgttcacggcttttagttcccccttctcaaaagtgaggcgcaactgctcgctgccctctttggtgcagtgtttcagataggcgctttcgggcaacccttgcgcggaatccagaatctcgccaccacaaatggaagtgccccacaaacctacgttataggaatattttagtttggtgaagtcggcggcaaagccgtgtttgttcagataatcaatctcttcctgacggctcagtgccatgtcgcgtgtcagcgtgatgatttccacgcccggagccatgacgaggaaagtcatgtcgaaacgaatctggtcgttacccgcacctgtagaaccgtgggcgatggcatccgcgccgatttcgttggcatagcgtgcaatggccaatgcttggaagatacgttcggaacttacagagataggataggtgccgttacgcaaaacattgccgaataccatgtatttcaagcttttctcatagtattcctgcgtcacgtcgagggtgacgtattctttggcgcccagcttgtaggcattttcttcgtttgtcttcaactgttcagcactgaaaccgcccgtattggcacaagctgcatatacttcgtaccctttttctttggtaagatacatcaccgtaaacgaggtatccaaacctccgctgaatgcgactactactttcttcttcttttccatatccttagtatttttatattttatcctcttcgtgcagcttcgggtcgtaaagcattgctgtgcaaatgcagaatttacggttcttagctaccaatatatcatggtttatacagccttcgcaacctttccagaacgattcgtcatcggtcagttcgttgaaggtgacgggcacatatcccagctcggtattcattttcatgacggcagctccgctggtgagactgaaaactttagcattaggccagcgtaggcgtgccaggcggaaagaagcggtcttgatacgttttgccagccccagtccccgatatttggggtgtactatcaaaccggaggttgctacatattgcttgttaccccagctctctatgtaggtaaaaccggcaaaatcatctccacacaaggctatgatggcctttccttctttcattttagtagctacgtattcgtgtgtgcgttctgcgatgcccgttccgcgtaccttggcagcttcccggatggtatccaaaatcttgtctacgtaaacttcatgtgaggcgtcagccaccatcacatcaatttgtttcgaatccatttcttatttaatttcttgttttttgttgttatctatcatttaatgttcgggatgatttgcgataggaagctgcgtacctcgtcatgtgacgctgcttcgtgcaccaccagcatgatggtgtcatctccggcaatggtacccagaatggcgggacactctcggttgtcgatgtcgtaggccatgctgctggcatatccgggccgggtacggatgacggcaatattgcccgaaaattgaagtgaaacgaatccgcttgtcatcagcatttcacttgcactctggtcgttcgaacgtttatacatgatgttgttgggcagcacatatacgtatttaccgttcatgttcgctgctttcgctactttcagctgtttcaagtcgcgtgacaaggtggcttgtgtcagttcaaagccttccttgctcaaagcttgcaacagttcttcctgagaactgacgtctttgcttgagataatcatcttgatggcgtctaaccgattggcttttttcttcattttctgtataattattctaagagtggcgcaaaattagggattattttggaaagaatatgcaaaaaaggagagtttttttattctttttatacataggtatattatatatgttgttcttgttctctttgtagcagccttgtttatctgttctttcacgttattggggattgtttctgtatgcatttgataaatgttgatataatatagaatagatatgcaattgccaaatctgacaccctttcaatcaaaaactgtacaaaaagtagggggataatctcctatttttgtatcgttgaatagcaactaaaactaattaccatgaaacaatgcttttttgcggtcgacttgggggctaccagtggtcgcacaattctgggaacttttacttcgaatggtttggaaatggaagaagtaaaccgtttcccaaatcatctgattgaagctggcagacatttttactgggatatttatgaactttaccgtcatattattgaagggctaaggattgccgcccgtaaaggtgtagaaataacttccatcggtatcgacacttggggagtagattttgtctgtgtaggtaaggatgggggatttcttcgccagccgtattcctatcgtgaccctcatacggtgggtgctccggaagcgttcttcacacgtatacctcgtagccatgtgtatggatggacggggattcaggtgatgaatttcaactccttgttccaacttgatacattacgccgtaatcatgacagtgcattggcagctgcagataaattgctgtttatgcctgatgctttgagctatatgttgaccggtcagatggtaacggagtatactattgccagtacggcacagttggtaaatgccaatacctgcaggctggaggatgccttgctgcaggagattggactgacacaagctcatttcgggcgttttgtctatcctggtgaaaaaatagggggcttgacggaggaagtacaacgaataaccggacttggcgctgtccccgtgatagctgttgccgggcatgatacggcttctgctgttgctgccgtacctgccatggaccgtaattttgcttatctaagtagtggtacttggtctctgatgggagtggagacggatgctccagtcattactgctgaaacagaatccttgaattttacgaatgaaggcggtgtggaaggaaccattcgtttgttaaaaaatatttgtggtatgtggctgcttgaacgttgccgtaccgaatggggggaaatcccttattctgaactcatcgttgaggctggtacttgtgaaccattccgtagtctaattaatccggatgatgctttgtttaccaatccggcgaatatggagcaagccatcaagacctattgttccgattatcgtcagcctattcccatgacacatggacagatagtacgctgtatctttgagagtcttgctttgagataccgtcaggtgctggatagcctgcgaaatctttcaccacgtccggtggaggctttacatgttatcggtggcggtagccgtaacgaactgcttaaccagtggacagccaatgctgtcggtattcccgtgattgccggaccttccgaagctactgctatcggtaacgttatggttcaggcattggctgccggagcagctagagacattgcttccatgagacagctcatcaaccgttccataccattaaagactttctatccgcaggatatggaggattggaataccgcttacctgcacttcaagcaattgacgatgactaattataatggataatgattaccaataatttataactcataatcaaatcacgtatcatgaaagaagaattgataaacaaagcgtatgaaattgctaaagagcgttacgcagctctcggattggatgtagaaaaagtaatggagcaacttcagaaagtgtctatctctatgcattgttggcaggccgatgatgttcagggattcgaatctgccggctcattgaccggtggtatccagacaacaggaaactatcccggtaaagcccgtaatatggaagaactgcgttccgatattttgaaagctgcttcttatatccccggtaagcaccgtttgaatttgcatgagatttacggtgactttggcggtaccttcgtagatcgcgatcaggtagaggtgaaacatttcgaaagctggatgcaatgggcagccgagaatggtataaaattggattttaattccacttctttctctcatccgaagagcggtaatctttctctggctcatccggaccaaggtatccgtgacttttgggtcgaacatactaaacgttgtcgtgccattgccgaagaaatggggcgccgccagggagatccctgcatcatgaatctttgggtgcatgatggtagcaaggatatcactgtaaaccgtatgaagtatcgtgtgcttttcaaagattctctcgaccgtatttttgctacggaatacaagcatatgaaggactgccttgaatcgaaggtgtttggcataggtttagagagttatacagtaggctccaatgaattctgtatgggctatagtgtacagcatcagaaacttattaccattgataccgggcacttccatcctacggaaagtgctgcagacaaggtgtcttccatgttgctctttgtccctgagctgatgctccacgtaagccgtccggtacgttgggattctgaccatgtaactatcatggatgaccccactcttgaacttttccaagaaattgtccgttgcgatgcactggaccgtgtacacattggtcttgattattttgatgcttccatcaaccgtatcggtgcttatgtaatcggtacccgtgcggcgcagaaatgcatgttgcgtgcgttactagaaccattggcaaagcttcgcgaatatgaggccaccggtcaaggtttccagcgccttgctctgctcgaagaggctaaggctttgccttggaacgctgtttgggacatgttctgtctgaaaaacaatgttccggtaggtgaggagttcatcgctgaaatagagaagtatgaagttaatgtaacctctaaaagaggataggaaacccttgtaactgacagaaatggaaataatattagggttattgattattgccatcggagcattctgccaatccagttgctatgtacccattaaccgcatcaaggagtggagctgggagtcgtattggattgtacaaggtgttttcgcttggctggtttttccgttcttgggcgcgttgctggcagtacctgccgacaattcgctgttcgagatttatgcaaacaatcctgcggatacgctttggactatgttcttcggagctttatggggagtggggggactgacgtttggtttgtctatgcgctatttaggcgtagctcttgggcagtctatcgctttgggtacttgtgccggattgggaacgatattgactccggtatttactggtaaggcaggagatttgacaacatcggttattgttggtgtagtggtcacgttggtaggtattggcattatcggtctggccggtagcatgaagtctgccagcctgagcgaagaagagaagaagaaggccgtaaaggatttcaattttactaaaggtattattgtagcccttcttgccggatttatgagtgcgtgtttcagtataggattgggttttggagagaaactctgttttgctgaaagtgcggatatattcaagacactgcctgctacattgatggtgacacagggtggtttcattacgaatgccgtctattgtttctatcagaattccaggaacaaaagttggggcgattatggcaagaaatccctttatgtaaacaatgtcttgttttgtgctttggccggtgtgttgtggtacagccagttctttggtcttagcttgggtaagggattccttgctgcctctccggtattgctcacattctcgtggtgcatcctgatgtcgttgaacgtaacgttctccaatgtttggggtatccttttgaaggaatggaaagggtgtacacccaagacaattacagtgcttgtcataggcttggcagtcttgataatttcttctttcctgccacagttgctggggtaagtttaaatacctatctttgaatataaaactaaaatatatctgcatatatgaaatcaattctagaaaatcgtccggcgctggctgcggaagttaataaggtggctgaggtggctggttatctctggcagaaaggttgggcagaacgtaatgggggcaatattacggtcaacatcactgagtttgtagacgatgaaatcaaggctatgcccgccattagtgaggtgaaatcaatcggtgctactttaccttatttgaaagactgctatttttattgcaaaggcaccaacaagcgtatgcgcgatttggcccgttggccgatggagaacggttcggtcatccgcattttggatgactgtgccagctatgtcattatagccgaccagtctgtacagcctacatcggaacttccttcccatcttagtgtacacaacaatctgatagcgaaaggttctccctataaagcttcggtgcatacgcatcctattgagctggtagccatgactcacaacaagaagtttctggaaaaagatgtagcttcgaacctgctttggagtatgataccggaaacaaaggctttctgtccccgcggtttgggcatcatcccttatcaacttcccagttcggtagaattggctgaggctaccatccgcgaactggatgactatgatgtagtgatgtgggagaaacatggtgtgtttgctgtggatgtggatgtgatggctgctttcgaccaggtggatgtactcaataaatccgcccttatttatatcgctgccaaaaatatgggttttgaaccggatggtatgagccagcttcaaatgaaggaaatgtccgtagcgtttaatttgcccaaataattgttttaacagatagtgtgtaattatgtatagaatgatattgaatgagacctcttatttcggtgccggctgtcgcgaaacgattgccgtggaggctgcccgcagaggtttcaaaaaggctttctttgtaacggacagagatttgatccgtttcaaggtggctgataaagtgattgaagttttcgagaagaacagtataccttatgagctcttcagtgatgtgaaggccaatcctaccattaccaatgtacagaatggtgtggctgctttcaaggcatccggtgccgattttatcgtggctttgggtggcggctcttccattgatacggcaaaaggtattggtattgttgtgaataatccggattttgcagatgtgaagtctctggaaggtgtggcggatactcgtcaaaaggctgtccctacttttgctttacctactacggcgggaactgctgctgaggtgaccatcaattatgttatcattgacgaagaggtcaaaaaaaagatggtttgtgtagaccctaatgatattccggcagtagctattgttgacccggagctgatgtattccatgccgaaaggattgactgctgcaaccggtatggatgcactgactcatgccatagaaagctatataacgccgggtgcatgggctatgtcggatatgttcgaactgaaagccattgaaatgattgctgtccatttgaaagctgccgtagacaatggcagcgatccggttgcccgcgaggccatgtctcaagcgcaatacattgccggtatggggttcagcaatgtcggtctgggcatcgttcattccatggcccatcctttgggtgcccattatgacactccgcatggggtggccaacgcattgcttcttccttacgtaatggagtataatgcagcgtccccggctgctcctaaatatgtccatattgcgaaggcgatgggagtcaatacggaaggtatgagcgtggaagaaggtatatgtgctgctattgctgctgtccggaaattgtctttaagtattggcattccacagcggttgcgtgaaatcaatgttagggaagaggatttgcatcaattggctatcgatgctttcaatgatgtctgcaccggtggcaatccgagacctacatctgtggaagatatagaagctctgtatcataaagctttttaaggcaagcgctattttaggttacatgtctattcccgtccgtgatgaataatattcgctgcggacgggatttttcataaataatctctatttttgttccggagctattatggaaggcacgtgttatgactaaaaattataatgatttaggagtagagtttaagtaccttattgtaaatgacatggaccagaaatatggtctttgggtaaatactgtgggctttcagtctatccagcctaattctccttatccgttgaaggatcatcctaccggttattttttcaatgcgcagaaaggacggattctgcgcgagtaccagttggtctatattactaaagggaggggggtgttctcctcggagaccacgccagagaagcaagtgtgcaaaggacgactgatggtgctgtttcctggtcagtggcatacatattatccttatgtgcagacgggttggaatgaatattatattggtttcgagggagctgtgattgatgatatggtgaaaggtggttttctatcgaaagagaatcaagtgttggaggtggggttgaatgaagagctcgtttcacttttctctcgcgctttggaaattgcggaagctgataagatttcttcccagcaatatcttgccggtattgtgctacatatgatagggatgatattgtccatctctaaaaacaagattttcgaagtgggtgatgtcgatcagaaaatagagcaggctaaaatcatcatgaacgagaatgtattcaaggatgttgacccggaagaactggcaatgaagttgaatatcagttattcctggtttcgcaaagtatttaaggattatactggctatgctcctgcaaaatatttccaagagctaaagttgcgtaaggctaagcaattgctggtgggtacttctttatcggtgaaagaaatctcttttatgctcgactataagtctaccgagcatttcttctcctcgtttaagaaacgtacggggttcactccattggagtatcgctcttatggtcgggaaaccggaggagaggaggtataaaacaaaaaaagacttaacttctaagagttaagtcttttctgtcggaatgaggcgactcgaacgcccgacccctacgtcccgaacgtagtgcgctaccaactgcgctacattccgattgcttttgaaaagtggtgccaccaggaatcgaaccggggacacaaggattttcagtcctttgctctaccaactgagctatggcacctttttcgtttgcgggtgcaaagataaagagttttttttataccgcaaggctttttgaggaaaaatatctaaaaaaggtgcctcttgctctatggagcgaggcaccttacttctaaaaatcatttgctatcgaagacatcagtcgatattcggattgatgctgtgccagtctttgatggcaggcagtacacccatttctatcacctcgtcacgaagtgtgcagagatgggcatagctttctttcagtttggcttcttcttcgggcgtgccgttcagttccttatagtgtacaccgtctttggtaatttcagtttccattgccatcatgatgtggtcgaagccgtggctgtgtacatatgtaccggcaggccagcggaacggtttgccacccatcgctgcagctatcatttcgatagagacgtatgccggactctggaaggaagaacgtccacggagggcgatgatgttggcaccgcctttggttaccttagtctggatttcgacccactgttctttagtcagggcaggggtaccgatgatatcaagtaacggtttaccgtccaccttggcggtagaggcatatacagccatctgttcaccatgaccgccgtaggtacggcaattttcgattttgtcgggggcgatgccgaagtgcttggaaagttcactgcgcaggcgggtgctgtcgagggcagccaatgtggtcacttgtgaaggtttcaggccggaatacaatagggtaatcagaccggtgatgtcggcagggttgaaaatgacaaccacgtgcttcacatccggacagtaggcttttacattcttaccgaattcttcggcaatagcggcattgcctttcaaaaggtcttcgcgggtcatgccggccttgcgggcggcaccgcctgatgataccacatacttggcaccggtcagcgcttctttgatatcggaggtaaatgtgatgttcattccttcgaatccgcagtggaacagctcttcggccacaccttccagtccgggagcataagggtcgtacagacataggttgggagtgagatgcatcatgattgcagtctgtgccatgtttgaaccgatcatgccggctgcgccgacgattgtcaatttgtcatttgtcagaaattccataatcttttttatttaaaggtgagtaatatcttttcttgctgattgtcacgatacaaagataaccctttttgaagagagttgttcatagaaaaaagttatcttttagagcaaaaagttatttcttctttccgaactgctgtattgtacctaaattacttatctttgttgggaaaatgaagataagtaagaaactatgagcattgagttaggaaagtacaatacgctggaagtggtgaaggaggtagccttcggcatgtatctggacggtggcgaagaaggtgaaattctgcttccgtcgcgttatgtcccccaagactgtaaggtgggagacaaactgaacgtttttatatatcttgataacgaagaacgtctggtagccactactctgacaccgttagtgcaggtcgggcagtttgcctgcttggaggtggcgtggataaaccagtatggtgctttccttaactggggattgatgaaggatcttttcgtccccttccgcgaacagaaaatgaagatgcaggtgggaaagaagtatgtggttcatgcccatttggatgatgaaagctatcgtatcgtggcatcggccaaggtagaccgttatctttccaaagagaaggccgcctatgagtcggggcaggaggtggatatcctgatttggcagaagacggatttgggattcaaggcgatcatcaacgatgaatatagcggcttgctatatgagagcgagatatttcagccactgcacacgggcatgaggatgaaagcctatgtgaagcaggtacgtgaagacggcaagatagacctgctgcttcaaaaaccggggcaggctaaagtagaagatttctcagctacgttgctggactatatccgtgaacagggcggacggatagctttgaatgacaagagtccggcagaagaaatctatgcaactttcggtgtcagcaagaaaaccttcaaaaaggctgtgggagatttgtacaaaaaacatctggttgtattggaggaagatggaatcaggattaggaattagtcccagtcattaggaatttccctacttgtaaatagagacaatcattagggaggggaatttcctctccctatttttgtcgtacaataaaaaaagaaaagtcatgatacgtcatttgatattaagtgtttgtctagttctggtagcgtttcccgcaataaaagcggcgcccatagacggaatccgtatagaaagtccataccgtagagtggtggtactggtcgatggacagcaggtttgcctgcctactttcagttgttttgtagccaatctgcgtggtagttgtcgggtagaggtttatgaagcgccatcccgtggggagaattcccgaagaggaaaactcctatatgatgaacgtgtgcattgctccatcaatgaagtggaagatattttcattccagaggacaaaagacctggtggaaactggggtacttctaatcatcacaagcctggcagacccggtgacagaccgttaggaggcgagcagcatgaaccggtgatgtcaccatctgccttcgaacagtttatggggctgatggaaaaacagagtttcgattcagaccgtaaggaagtgctcgaccatgccttgctgacctcttggttcactactgaccagtgtatccgtctgatggatttttatcgtttcgacagtgaaaagaaacagttgatgaagaagatttatcctaaaatagccgataaaccgaatttctattatgcgatagacaagctgaccttctcgtcggacaagaacgagataaatgccttcatcaaacaatatcatgagaagaataactaaaaaaaggagggattatgaaacggattatatttatatttcttgccgctatgatgagtacagctgtttgtagtgcggcaatgagcaacagcaaagtgcgtaaagagacccgttttcttacggacaagatggcctatgaattgaacctgagtacagaacagtataatgacgtgtacgaaataaactatgatttcatttccggtatacgttatctgatggatgacgttcttcggggggaggaatgggccttgaatcgctattacgattatctggatgtgcgcaatgacgaccttcgatgggtgctgaataaccggcagtacggccgtttcatgcaggccgcctatttttaccgtccggtttatgtaagtggtggtcgttggtcttttagggtttacatcacttacaccaaccataatcatttctatttcccgcggccgtatcattaccgtacatattgcggtgggcattatcgtacgcactatcacaacagctattatcgcggtcgttaccatcatccgcactataccggttcgtggagtattcggaatgataagtcgtaccacaccagccgccgttcagatttcggttcggtgaacatccgccctaattcgcataagcgtccggcaggcagggatgatgtatataccacgcgacgtagtaacggtagtaataatcgcattagcacaggtacacgtaacagcagtacgcgacgtagtagtgtggatagtggcagaaagtcgagtaaagagaaaatagaaaccacaagaactaaaaataatgataagagccccagccgtagcagggtaaagacggcaagcaaggaaagaagaaatgcttccggcgtacggagttccgaaagccgtcgcagcagctcttcaagcactactcgcagttctaccggcagtagctcttcccgctcttcggaaaggagatagaagaacaaaaaactcccctcttgtcagcctggaggcagggagaggggagaatcaaacacaacaactaaaattatacttctttttttattcaatcggttctcccttatagaaatccagaatcttggtacggaacagatagtcatacttggcttgcaattcgtctgattgggatttcataaggttctgttttgcttcattgtattctacggcatttgcttttccgttctcatacttttcgctcatcagcttgaaagactcttcgctggcaacggtggctgtatggctactggtatatttgctttcagcagcagcggcattgtaccatgcttgttggatttctttataaagtgtcttcttggcattatccaattgcaaggcatagttttcacgttgcaggcgtgccgtgcgtacccggttacgggtagagagacggttgaaaataggtacgctgaggttgaatcctacgtatttgttgaagttatcgttcatctgctggctgaaagtacggtcgatggtagaatagtaattcgtaccgagactaccgttcaggctcagttgcgggtagtagttgctctgggcaatacggatattgtgtttactgccttccaagcggaactgtgcagcttgtatggaagccttacttaccatggctgtttggaatatctcatccggaggagtgagagggactaaatccagattgactgccggagattccagattgaacccttccggtgtttccagttcgataagctggctaaggtcgagcagggccaacttatagttgttgtttgtctgcactacattcatctcgtcttgtgccacacgtgctttggcttctgccagttctgccggagaggcttttcccaagtcggcaagccggctgatgcggacatattgctctttgctcaattgcacttgtcccaacgccacctggtggagctcttcattgaacagcacctgaaggtaggccgaagctatattgatggcaatgtcttccttggctttgtccaggtcggcaatggcagctttgaggtttagtttggccaatgcatactggtggggaatttccagaccggtaaagataggtatgctggtattgacagacatattagtgccgtggctgctggtgttgacgtatacagtggaatagtctcccgtatcctcatttttgatggctgtttgcgtacgtccccagttccagctctggccggcactggcattcaggttcggcagtcgtgcccatttggctgtatttacttcgacagcactctgttcggcagcgttggctgtctggcggatactgatgttatgctcgatggcatagtctatgcattggcgtaaagaccatcgttcctgcgcctgcactgagatactgccgaatattgcgaggtataagaatatctttttattcatatcgtatatctttttaagctatttcgtttgttaatcctttttctctgcaccgcgaatcttatcctgggcactgataccgcttttgatggcaatctttatgccgtcactcatgccgacctggatggggcggcgttcgaacttctgtaccggtacgctgtccgtcattacgtatacaaaggtgctgtcaccattgaattcaatggtactttccggtacggcaagcgttttctgggcacggtccaatacgatttctgcgttggcagaatagccggaacgtatctgtacgctgtccggtgcggcaatggcagctttgatttcaaactggttggcaccgttttcttccacacccttcggagatatgtattccagtgtggcatcgaacgaaagattctgcagggcgccgattgtcagtttcaccggcatgccttcgtgcacacggcccacttccgtttcgtcaatgttgccgcggaaaatcaaatcgttcatgttggcaacggtagcgatggtggttccgtcattgaaagtgttactcatgataaccgagttaccgactttgatgggtacatccagaatcagaccggtaatggtggaacggatcagggtactactgaaagaggcgctgttcttggtgatgccttcctttacaatttccaggttatcttttgctgtctgcagttcctcgcgtgcctgcttcacgcttacttcccctttttcgtactcttcagcgctgataagcttgtcgttgtacagtttctgggtacgggcgaaatccgtttcggcttgggcagcgttgatttccgccaatcgtacgcggctttcggcagagttcaattgtcccagttcgggtatcacctttactttggcaagcacttccccttgcttcacactttgtcctgcttccttgtatacttcggcaatgataccggaaatctgcggcttgataaggacttcatctctcggttccactttgccggtggctacggtagtcttttcaaggtctgtcacttccggaactatcgtttcgtatactgttactttaggttgggacttctggtacagaaaaacgaatgtccaaatgaataaggcagcaattactaccaataatgcgattttcagaaacttctttgttttcatcttatatttacgatttaattatttacgattgatatagccattatttcatggcttacggttagtggtctctctataagtttattcatccctgatggcttcaattggcttgattgccatggcgcgataggcaggtgccagtccggcaagcactcctaatgcgatgaggaggatgcaggttccgatagccagtccgaatgaaacctggtagtgggttttgataactccagggtcattggcggccttttcaagtatttgcagtacaaatacggcaaaagaaatacctgccatacccgctatagtggtcagcaccatgctttccgaaagaatttgttgcagaatgtctttaggacgggcacctatggcacggcgtatgcctatttccgttgtgcgctccttgacggttaccatcatgatattcgatacgccgatagctccggcaaacagcgtccccaaacctaccatccagattagaaagcgcactccaatcatcaggttgtccatcatggagaacatagcttccgcattcagaagcatgacggcttgtttgtcatcgggagcaatgtagtgcgccgcttttacaagacgttccacttcgggctgcacgtctttcacttttactcccggtttcatgatgaaacatactacatgcagtttctttccgaggttgtaggtctgttgcatggtggaaaaaggcaatgtaatggcttcagaggcctgcccttgtatattgacattgccttcggatgaacacattccgataacccggtaatagataccatttacccggacatatttgccgcaggggtcttcaccgggtttgaagaggctttcataaacacgtttgccgattacacacactttacgcgactctttaatgtcgacatcattgatgaaacgtccataggtcatctcttgatgttctatctgttcatattcgggatacaagcctttcacactacagtcgtacttgttgtctccgtagacagccacttgtccccataaggcaatggaaggcgtggcaagcgccacaccgtccacattgcgtacacggtctacatcttccatctccaaatcccaccatcgtcctttgcgaaaacctttataagcctcgcttgtcttttgtgcagcgataaagcccgagttggttgcaaatccttcgaactgggattttagttcttcctgcatgccctggccgccaccgataagcgccaccagcataaagataccccagaatacgccgaacgccgtaagcaggcttctcgttttgttccttgttattgtgatgaggatttcctcacacgtatctatgtctattctcataatctttaatctgctctaagtgcttcaataggactgatacttaccgctttcttagccgggaagaacccagccaacgtacccgctatgataagggtcagggtagcttggatagcaatactgaggtctacggtaggatcggagaacatggtctgctggaacatgccggcatccatcgtctggctaccgaaagcagagttcatccattccgtcaccccgatgcctgccaccataccgatataaccgaatagcgtagtgatagtcacgctttccacaataatcagccaaaggatggagaaaggttttgctcccaatgccttacggataccaaattcccgggtacgttctttcacggtaatcagcattatgttcgacacgccgacaatcccactcaacagtgtgaagataccgataacccagattgcagtccggaggatacccattgcattctgtgtctgcagatagttggtgaaacgattccatatccatatggcgctctcatctgtggggtcaaagcggtgattggtggcaatagccttgcggtattctttttcaaaggcttcgttactttctatgctgtgcaggttcttggttgtaaagatgatgttattcagcttgtctcctttattatagatggtctgcaaggtggagaaggggatatacgcttcgtttgcctcgcggtctccctggtcattgtagaggcctactacttgataggccactccactggcattgacaaattgtccgatgggttcagtatgcgtttttccgaaaaggatatctgcagatttcttatggaggatgatgactttacgtcggtctttcaggtcgttgtagttgatgaaacgtccgtccgctgttttcacggtttccacttcggtgtagttgggatatacgcccagcagagagatattgatatattcttgtccgaagctgacgtttacattactttgacgcacggtggcaccggcactgatgacattttcggtgaattgcttctccgtgtcatccatgtcccggttgtccagttggacgcggcgtccttctttcagaccgtcgtatgacttggtggtccagccggggaagatgcggatagagttcaaggcacgctccgacgcattttgctcgaaggcatgtatgataccgtttccggctccgagcagcacgatgagcatgaagattccccatgccacggcaaagcccgtcaggaatgtacgcagtttgttgcgtttgatggttccgtatatttcttgccaaaggtctatcattgataattaaaaattaagaattaaaaattaaagggggagggggctcttcctttattatttcatgaatccgtcttttccgaacgggcttgcatcgtggttcagattcgtctcgatgctacctatgataccgtctttgatatggataatcttgtccgtctggttggcaacaccgctttcgtgggtcacgactacgatggtcatgcccgtatcgtgcagttcctttagaatctgcatcacctctacggaagtcttgctgtcgagcgcgccggtaggttcatcggcaaggataatctgcggttgggtaatgagggcacgggcgatggctacacgttgtttctgtccaccggacatctcatttggcatgtggtgtgcccactctttcagccccaggcggtccagatattccagtgccagcgcattacgtttgcggcggctcactccttgataaaagagaggaagcgccacattctccactgcattcttgaaggaaatgagattgaaggactggaagatgaaaccaatcatacggttgcggtactcggctgccttcgtttcgctgaggttcttgatgagggtaccgttcagataatattcccccgtgtcgtaactatccagaatacccagtatattgagtaaagtggactttcccgaacccgatgagcccatgatggaaacaaattcgcctttctgaatgtcgaggttgatacctttgagcacatgcagcggtgctccgttgttgtaggtcttgttaatgtcttttagttgtatcactgttttccctgtttattgctttactcttattaattttcactattagacgcagcaatgctacgaaaagttgcaaaagttgcaaacttttttaaaaaaagattttgcagtgtcgtttttctttgtgatttttgtaaccatgaatgtgattaactaaccctttaaacaaaagtaatatcatgaattcaaacatggaaaagccctatgtagtgggcattgacataggcggaacaaacaccgtctttggtattgtagacgcacgcggaactattattgcaagcagttccatcaaaaccggagcttatgaggacgtcaatgattacgtagacgaagtttgcaagaatctgttgccgctcattattgccaacggtggcgtagacaagataaaaggtatcggtatcggtgctcctaacggaaactattacagcggtactattgagtttgccccgaaccttccttggaagggtgtaattcctttggctgccatgtttgaagagcgcttgggtatccctaccgctttgacaaacgacgccaatgctgccggtatcggtgaaatgacttacggtgcggctcgtggtatgaaagactttatcatgataactcttggcaccggtgtaggtagcggtatcgttattaacggtcagatggtatatggccatgacggttttgccggagagttgggacatactattatccgtcgtgaaaacggacgtctctgcggatgcggacgtcacggctgtctggaaacttattgttcggctacgggtgtggcgcgttctgcacgtgagttcttgaccaagagtaccgaaccgagtttgttgcgcgacattccggcagaaaacattacttccaaggatgtgtatgatgcagcggtgaagggtgacaagattgctcaagacatctttgagtttaccggaaccatcttgggtgaggctttggctgacttcatcgctttctccagtccggaagctatcgtgttgttcggtggtctggcaaaagcgggagactatatcttcaagcctatccagaaagctattgacgacaatgtattgaatatctacaaaggtaagaccaagttgctggcttccgagttgaaggactctgatgctgcagtgctgggtgccagtgcgttgggctgggagctgagagatatcaagtaatcaatattagggaaactgataaaggaggggatatgtcaaaactccccttctatcgaagtcaccctcgctacacctatctgtggcgagggtgatttttagtttatgagagtttcgacacacctttttttctttggtggtacatattcctcagcaataaagttatgtcacaagttgcttccacacttccacccattctctgtatccctttattcatcggggttgcggatgctgtggaagcaacttttgcttccaccttaaatttacgccaaataatctattaatatcttgtagtacaatgaattaataggatatggagcaatttgccaatatcgtgtaaacaagctattggtttcctgcaaacacggtattaacttcgtaaaagcccgtgcgataataggtggaagtcaggtttttggtatgaataagataggtattcagtataggcaagctatgcatatgagagctgtttaacggccgtgaggcgttcgcctaacggccataaagcaccttgttgacggtcgttagcagagcgcctcacggccgttgggcgctgataaactaacatatcagcaagaaggaaggcttatgtgaaaggaaggagcgcaggcttacaatgttttgaatgagggagtagcagtagagtatcgcatggtgtgtatgcctactgtgtatatcactaaaaaagggaaaccgacattgtcagtttcccttttttatttcgaaataggagtctggaattaaccgttaactcttttttctttgattcttgctttcttaccggtaagagcgcgcaggtagtacagtttagcgcgacgaactttacccactttgttcacttcgatgctgtcgatagccggtgattcaatcgggaaaatacgttctacgcctatggttcctgacatcttacgtactgtaaaacgcttcttgtctccatgtccggcaatcttgataacaacaccacggtacagctgtacacgttccttgttaccctcgacaatacgatatgctactgttacagtgtcacctgccttgaagctcgggtgctgttttccggtagcaaatgcttcttctgcaattttaattaaatccattgtttttattattaaattgtttcatcgttacaacgcaacataccaggcttctctcttggtgtcctgacagcgattgcgcgaaagcggtgcaaaggaacgaattatttgccagatacacaagtgcttcaagctttttttcgccagttgggatgatttttgagcgtttcattctgctaaacgcaagtctaaataatcggttaattgtgtggctcagtcgcaaaagaaaagtatatttgtagcaatttaaaactaaatgaatatgaagaaacaaactttcagtctcctttcgggggcagtgttggcggttgcgcttctattggtttcctgccattcttcctacgaagtaaccaaggtagagggaggcagaattcccatgaactctgtctgggatgccgagccggatgccgaagccgtggctctgctggcgccttacaaggcccggatggacagcgttatgtatcatgtggtgggaaccgcagaaatgtcgatggacagattccggcccgaaagccttttatccaatctgattgcagatgtactgcgtgaggctgcggtggaagtgctgggcaaaccggccgatatggggctaatcaatatcggtggaatccggaactccctgacggaaggagacatcactaccgaaaacatctatgagatattgccttttgagaattcgctctgtgtgctgacgatgaaaggctctgccatgaagcacttgtttgaaaacattgcggtgagacttggtgaaggggtgagtggtatacagttggaaatcagcaaggatggcaagctgctccaggcttccattgccggcaagccggtggaggatgaccgtgactatacggttgccacgattgattatctggctgatggaaacgatggaatgacggctttcctgcaggcggataaaagggagtgcccggatggggctacactgcgcggtctgttcatgaagtatgtggagaagcagacggcagccggcaagaaggtgacttcgcgcatggagggaagagtggtcgttaaagagtaagcattaaaaaaacagaagttctatgaaacatatgtattccttggcagccctgctgcttttcatgctccccgcatcggcacagcaagaggagcgtgtcattactgaagaacccctttgcctggtgtccgccgattctgtatcgtccggccaatccggaaaacaactgtttatcctgcacaccagcgatacgcacagccgtatagaacccatcagcgccgaggctgccgacgagtatgccgggatgggcggtgtggtgcgccgtgccggttttgtaaagcagtttcgcggcaagcatccggatatgttgctgctggattgcggagacatctcgcaaggcaccccttattataactttttcaaaggcgagctggaggtcaagatgatgaacctcatgggctatgatgccatgacgataggtaatcatgaatttgatttcggacttgagaatatggcggaattgttccgtatggcggattttcccgtggtctgttccaattatgacgtgacgggtacggtactcgaaggactggtgaagccttatatcaccttggtgcgcgaaggggtgaaaatcggtatcttcggcctggcccccaagatggaagggctggtgcaggcggataaatgcgtaggcattgtctacaacgacccgataaaggtggcccaggaaatgacagaccttctcagggagaaggagaattgcgaggttgtgatttgcatgtctcatttgggtatccgcagtgcaaatcccgaaggcgcttccgacgagaacctggtaggcaagacgcgtggcattgatgtcattttgggaggacattcgcatacttttatggaaaagcctgccgtttatctgaatgcggacggcaagagcgttcccgtgctgcacaccggaaagagtggcatctacgtaggagaaatggtacttactttaactgaaaaatagcatgatgaaaagactcaccctccttttatgggttgcaggattgtttatattgggattatcttcacttcacgcccagacggggggcccgtttcttccttcggctgcagacaaccggtgccggcaatgggtggactccgtgttgtcaggtctgaatgtacacgaaaaagtggggcagctcatcgttgccaccattccggccagagcagacaaggccacgaaaaagcagatgcgcgagctggtaaagaaatacaaggtcggtggcttgctgttttccgaaggtactccggaagagcaggctatcttgaccaatatggcccggaaggatgccaagattcccgttatggttactttcgatggagagtggggactgtcaatgaggctgaaaggcgctccggactatccccgtaatgccgccttgggatgtatcgaggacaatggcctgattgaagaatatggacgtgaggtggcccgccagttccgcgaattgggggtacacgtcaattttgcacccgatgcggatgtcaatacgaatccgctgaacccggtgatacacgtacgctcctttggcgagaacccgcagcgggtggcagaaaaggtggtggcatatagccgtgggctcgaaagcgggggcatactttccgtttgcaagcatttccccgggcatggcgatacggatgtggattctcataaggcgcttcctgccttgcactacgaccgtgcacgcctggacagtgtggaactttatcccttcaaggaaatggtacgtgccggattggggggggtcatggtaggccatctgcaagtgcaggcgctggacccggacggggtgactccttcttccttgtcgcggaatgtggtgaccgggttgttgaaggatgaactcggctttaaagggctggtgtttaccgatgccttggacatgaagggtgtgtctgccattccgcaggtaactaccaaagcgctgctggcgggaaatgatatggtgctggtacagttcaatacgaagaatgcggtgcaggagctggtagatgcagtggagtcgggacaactgagtaaggacgaacttgatgccaagtgccgcaaggtattgatgtacaagtatatgcttggtttgagaaaccgccagccgcaacttcgggtcagcggaatgagctatcgcatcaatacggaggaagcgcaggcgttggctgccaagttgcgccgttcggcagtgactgtattgaacaattatttcgatgtcctcccgctggcaccggtggaaggtgatattgccgtgctcagcatcggagagaaggaggcagatgctccctttgtggaagctatgaaaaagaatgcaggcatcagccatttccacttgccttggaatgccgatgaggctctctggcaggaagtgcaggggcagttggctgctttccgtcgcgtggttatcagcatcaccggttcggcttatgtcagcgaccgtgatgtggcctttctggaaggcttgaacctgcgtgctccgctggtctatactttttttacctcttaccgtacattgcaacctctgatgcccgcacttgccaaatctagcgctgtggtgctggcacattcggcagagacggatttgcagcaatacgtggttgatgttctttttgccaaaaagccggccagtggcagaatgtcgatgagtatcggtaaactgtttccagcgggaacgggctgtatgattgaaccgggcatgaaaccggggaagactgttccggaagattacggcatgaaatcgtatgtgctgcaaagtatcgatgccgttgcccggaagggactggaagcgggagcttatcccggttgccgcgtgctggtgtggaaagacggactgccggtatatgacaaaggcttcggaacccactctgataaggataccactactgtccgttcttcggacctttttgatttggcttcgctgaccaagactacggctacgttgcttgccgtcatgaaactgtatgatgagggcaagataaaactggatgacaaggtttccgcttatctgcccttcttgcgcaatggcaacaagcggaacattaccatccgcgaacttttgttccacgaatcggggcttcctccctatatccgcttctacctggacatcatagacccgaattcggtacacggtccgtactcccagagttgggtggacgagtggcatcgtacgcaggtaagcgagcatagctattattgttccgattttaagttccggaaagggatggtgtccgacaagaatacaccggcctatactctgcacatggcagatggcatgtggctgaacaagagtttcaagaattctatccttcagcggatagccaagtgcgagttggatggcaaacgttatgtttacagcgacctcggcttcgtgctgttgcagcaggtagtggagaaggtgacggagctgccgatggatttgtaccttgcccgtgagttctatgccccgatgggattgcaacgtactatgtttctgcctttgacgaagttcaccaaagcggaaatcatgcccacggcatccaatgacttcctgcgtcgccaggatatatgcggatatgtgcatgacgagactgctgcctgcatgggtggggtgtccggtaatgcaggacttttctctacggccgaagaggtggcaaaggtttatcaaatgttgctgaacggcggtgaattcaatggcaagcgtttcttgagtgaggcaacctgccgtttgtttacgacggagaaatctgccatcagccgtcgcggtctgggattcgacaagccggatgtatccattgtgaagcgcagcccttgtgctccttccgctccggaagcggtatatggacataccggatttaccggtacttgtgcttgggtggacccggaaaacaagacagtgtatgtattcctcagcaaccgcttgtgccccaatgtatggaacacgaaactgggtgacatgaatataagaagagatatccaggaattgatttataaaagtattattccgcaaatcccctaaaaacaatctatctataaggaatgaagagaatatacctgcttgcctatatcactatattgtgttgtctttgtccgcttctgaaagcgcagcttggcccgatgccgtttactccggtgccgccgaacgacccttcgcttgtacgtctcttgaacagtgacgtgcggtgcaggcagtgggtggattccgtcatgcagcgtctgactctgaaagaacgcatcggacaactgttcatctatacgattgccccccagcaggacaaggccaacaaggaactgctgcgtaaggtggtggaggactataaggtaggcggtctgttattctccggcggattgatgcagaaccaggtgatgttgaccaatgaggcgcagcggatggcggaagttccgctgatgattacctttgacggtgaatggggactggctatgcgcctccgcggtactccgaactttccgcgaaacatggtgctgggctgcatacagaacgatacactgatttatgaatatgggcgcgaagtggcccgccaatgccgtgaactgggggtgcaagtgaattttgctcctgtagcggatgtgaatatcaatcccaagaatccggttatcaatacccgttccttcggtgaaagtccgttcaatgtggcgaacaaggttgttgcctactccaaagggttggaggatggtggtgtactttctgtcagcaagcactttccggggcatggggatacggatgtggattctcataaggcgttgcccgtgctgccttttacccgtgcccgtctggacagtatagagctttatcctttcagaaaagccattcgtgccggattgggaggaatgatggtggggcacttggaggtgcctaccatagagccgcaaaaggggctcccgtcttcgctttcgcgtaaggtagtttccggtctgttggtgaatgacctcggctttcaggggcttgtctttacagatgcccttgccatgaaaggggtatcgggcaatgaaagcatctgtttgcaggcgctgaaagccggcaatgatttgctgcttgtcccccggcgtattaaggaagaagtggaggctgtgcttgccgctgtgaaaaaaggggagctgacagagaaagagatagaggcgaaatgccgtaaagtactgaaatataaatatgcccttgggttggaaaagaaaccccatgtacagctttcaggtttggggacccgcatcaatactccgaaaacgcgtgatttgatgcgccggctgaacttggcggccatcactgtgctggataaccgggacgaggtacttccgctggacccttccatcggtgaagttgccgtgctcaatgtgggagaagcgcaggaaatccagccgttcctcaaggaactgtcgcagtatacccgtcctgtggagttccatttgggcaagaatctgccggaggctgacgggaaccgtttgaggaatgcgctgaccaagtacaaacgtattctggtctgtgtcaccgaacaccgtttgacgccctatcagaatttctttgcaaagttcgctcctgacgtaccggtggtttatctgttctttattcctggcaagcaggtattgcagataaaacaaggggacgctgctgctgaagcggtgattttggcacactcctccaacgaggaggtacagcggcaggttgcccggattgtttatggcagcgcttgttcagagggacgcttgtctgccagtatcggtagtcggtttgctgccggtgcgggagtgacgctgactcctcaaagcgccccccgctttgtacccgaagagcatggtatgaattcccgtctgctggctgaaatagacaagatagctgaagaaggcattcgtgaaggggcttaccccggttgccaggtggtggtgctgaaggatggtagggagatgtataataaagttttcggtacccacgtctggaacgaggccggaagcaaggcgcttcccgtaaagaagacggatgtatacgacatcgcttcgctgacaaagaccacagccacgctgcttgctgtgatgaagttgtacgatggcggacgcctcaatcttacagaccgggtgtcggattatctgcctttcctacaggatacggacaagaagaatattacggtacgcgaactgctgatgcatgaatccggtctaccttctaccttgctattctatcaggaagcgattgatgaagagagctacaccggcactttgttcaaggcacgtcccgatgcccggcattccgcacgcatcggacggcagacttgggcgaaccctaagttccgcttccgtcagggactgacgtcgaaggtgcagacaccggaatatacgatgcaagtgtccgacagcctttggctgaaccgttccttcaagcaagagtacttgcagaagattgtggatacttcgcttagagataaacgttaccgttatagttgtgtgggctttatcttgttgcagcagttggtcgaggcgcgcaccggcatgtctatggacgaatatctggccaaggaattctatactccgatgggattggagcgtacggggtatcttcctctgcgcttcttgaagaaggaagatattgtaccttcatcaacagatcctttcttgcgtaagactaccttgcaaggatttgtacatgatgaatctgcagcttttcagggcggcgtttccggtaatgccgggctgttctccactgccggagaagtggcaaaagtctatcagatgctgctgaatgggggtgaactggacggtaaacgctatttgagcaaggagacctgcagggtatttactaccaccgtctcaaggataagccgccgggggctgggatttgataagcccgaccggcataatccccagaagagtccctgcgcagagtctgcccctgcttctgtttacggtcataccggtttcacgggcacttgcgcctggacagacccggagaacggcttggtttatgtctttttgagcaaccgcacctatccggatgtgtggaataacaagttgatgaggctggatataaggacgaggattcaggaggcggtatataaggcgatgctgagaggaaaaaaataattggtacaaattaaaaagagcctcccttgctcacgcaggaaaggctcttttcttcttcaattttgaaacaattaaattctatctgttaagctttaagtgtgtgtcttatcagaacgcaatacctacgcgcagaccgaaattactcaaaccgtctacgctgtacgtaaagaggtcacctttgttcgtaccgtagctgtaataggctgcgaaatgcaagcccggtccataagcccaaggatacacattgaaaccaatttcaggagatacatagaaaccccatgtatctttgttggcttcgaatacgttgaaagttgacttcaactgtgcatattcagcacccagttttacaccggcatacggctggaatgcacctccacggttccatacatagcgggaggccagaccgaaaggcaactggaatgcagtgtgctgctggtcggtattcagactgccgccttcgcctacgggaagtgtctggcgaccgaaatactcatggttgctatggtagttcaagaaagctcccaatgcaaaattgtctgtcaggaagtaaccgccttcaaaattcataccccagccgcttgatttgtcggcgaagttgttgctgaggggaaagttatattgccagtcgatattggcataaccgttatcggtcatctgtgccttcgtcggtagggcgaagacgagagcaagagcggcaaccgcaaatactctcaaggaaagatattttattgttttcatactttgttcttgttttttggttcaatggcaacttcccagtccggaaaggatgctgccgtattattcttgttaccttaatattgggtaacccgtcatttgtcacttatagctcgtagcttgtcactacttgttagtcaggtaagttgattgagtgaaagcttggttcacaccttgcacggcaagtttggtattgacagaagtagaaccactcagcaagccgctcatatagctggtccacagaacaggaagtttctcgctctggccttgcggcgcctccagattcaacaattcgctgataaaggaaccggtactgtaggaatagttcacggcatagggataataccatccgccccagttgccccagtaaggagcatcccagtagcctggatagttccaccaccattcgggacgtccgtagtcggtgaagtaataggtacttctgacatagcttacctgcaagccaaggtcggcttcttcccggtcatccacacggatgtagccgcggctgttcatgttagcaacataagcgctgagaatttcctgggcattctcatctttccagtattcggcgttttccttatcaccgatgaccagaatgctgtccggcaagtaataagtttcgaaggttttgaaatccgccttcttgtcatagttggtataaaccagataattattgtccagcttatccatgtcagggtctttttcgcaagatgcaagcgtcactgcaaagaccgctaataataggggaataaatttcttcatacttttataattgtttaggtttaatataaattcctgccctatggtaccttaggcttttgtgagaaaaaacaagataggatataaaaggttcacgtagaggtatgttaaaagtgataaaggaatagggtgacagcacttttaacgtaactgtcaccctattgcacttatcatgtcattactttatcaccctatcatcttttccatatccgtgctgtccatcctcctccgggtgccatgtgtatgttcagcttgtctcccgaggtcacggtgcgtacttctttcttgtagtcggttgcttcccggtcggcattgatgccgtcggaaaagatttcggcttcgtaacttccttctccgaggaaggaaaggttgatggtacagtcgcgtggtgtccagtcggtcatggaggcgatgtaccagacgtctcccttgcggcgtgccagtgtaaggtattcgcctacttcaccgtccagtgccacggtctcgtcgaaaacggtaggcactttggcaatgaagtccgtgcattcctgctccttcatatatttgctggggctgtcggcaagcatttgcagcggggcttcgaagagggtgtacatcgccatctggtggacgcgcgtaccctggctcattggatggtcgttgacggcacggaaggtttcgcgggttgcgttcatcatggctcccggtgtgtagtccatcgggccgacaagcatgcgcaggtagggagcagtcacgtcatagcgtgggaagttgtggagcgggctaccgttcactatcggttcccatttggcattctccagtccctttacaccttcaaagttcaggacgttgggataggtgcgctgtataccgtatggcttgagtccatgcaggtccaataccaggcggtgctcggcggcgcaggctacaatgcgttctacagactgtaccagtggctggtcgtcacggtcgaagaagtctatcttgaagcctttgatgcccatctgtgcatagtggctgaatgcggcttccgtatctttggcagagtttcgccagcttgcccagagaatgatgccgacgcccttctggtttccgtaggctaccagttcctttaaatcgatattcggattcaggtctttcaataaggattcgtttccgctccagccgtcatcgatgatgatatattccaggttgttgtcggcggcaaagtcgatgaatgccttataagtcggggtgttcatgccggctttgaagtctacgccagtcaggttgcaggtgttccaccagtcccaagccactttgccgggtttaatccaggaaatgtctttgatgcggcaggcgggggcaagacgctgtgccatgtcattgtcggcaagctgcgtgtccttctcggtgacgagcaccacacgccaggggagctcctgcttggcacaacgggcgatgtagtctgcacgttttgtcggtatcaggttcagccggttgtgtccgccgattatttcctccagcggatagggggcaaatgctgcctgcactccttgacgtgtctggggatttacagtgaggaacatgccgggatagttttccaatccggcttccatgataacggctttctttcctccgtccaggcaaaccatcagtggggtgatggagagtgagtcggtgtacattttggacaacggggcttcgtcgtagtaagactcgaaggagaagcaatagcgctcaccgttgcggttgtcgtttatgtaaggtacaaatgcctggtaatccttgtcgaaattgaagtccgcagtttcgttgaggacgataaacggcttgttctgttcggaaatgaagcggtaggcagcgccgtcatcgtatgcgcggaactgtacgctgtagcctccgcggcatttcagtgtcagctggttgtagacatccttcacacttgcttttttatagaggggagtggggaaggaggactctacagacttgcgttctgcacggattacttttacatttttaccgaaagttattgctttcttggctgatttttcatctctgccttgcagggcgatggcagagggttgcagcaccgtggttccgtcgtgtgctatctgccaggtgagggcttctccggcatctaccgtaacggatagttttccgttgggtgatgcaagttggtattgctgtgcacggaccgtgcccaagcaaaggaataataaacaaaaggtttgaataaggaggcttttcatgttgatttatttttgaatgattttctttatcttctccagttcctcggcagagaagtctgtattttcagtcgctttcaggttatctgccagttgggcaacggagctcgctccgatgatgacgcttgtcaccaggtcgtccttcaacagccaggcaagtgacatctcggcaagggtttgcccgcgtgaggcagcaacctcgttgagtgccttgattttttgcagcgtctcgtcggtcagtgcttctttctttaggaaagccccctttgccatgcgcgaatcttcgggaataccatttaggtagcggttggtcagcaggccctgcgccagcggggagaaggcgatgaagccggttccgttccctttggcttgctgcaggataccttcttcttccggttcgcggttgaagagattgtatctgccttgatagagcaggcagtgtacatcccgttcttccaggtatttgtaggcaaactcggccgcctctttgggatatttggagattcctacatagagtgctttgccttgccgtacgatatcaaccagtgcttgcagggtctcttcaagcggagtatccgggtcgtagcggtgggagtagaagatgtccacatactccaggttcatccgtttcagactttggttgaggctgctcatcaggtacttgcgtgagccccactccccgtaggggccgggccacatgtcgtgtccggccttggtggagatgaatagttcgtcccgatagggcatgaaggatttcttcataatcattccgaaagtctcttcggcggaaccgtaggaaggaccgtaattgttggcgaggtcgaaatgtgtgattccacggtcgaaggcatagtgcgccatggcctgggaattggcaaatgtgttcacgtcgccgaagttgtgccacaatccgagtgatatttccggcagcaggatgccgctttgcccgcaacggcggaatttcatgccgttgtcatagcgttcgggcgctggagaataaatagggtttatcatgatattgtattttgtgggttatcccattattacttctactgtatgcgtgcccggcagatggttcaccacattgccttctatcggctggccgtctactgtgacggacttgatgcctttgcacacaccatcgggattcttcacggtaatatgatattctgccccgcggaacctacgcttcacgttgaagcctttccagcctgccgggatacaaggattgatttccagaccttcatacgaaggcttgatgccgagtatgaattgcgtgatggcataccacatccaggcagccgttccagtcagccagctgttcttgccttcaccagggcgggcggcgtccttgccggccaccatctggcagcatacgtaaggttctactttatgcagggcactgtgctcttcggtgtacgacgggcatatcttgcggaaatactcccaggaacggtcaccccgtcccagtacggtttctccgatgatgacccacgggttgttgtggcagaagatacctgcgttctccttgtagccggcgggataggtggagatttctccatactccacaacatagcgggtgaagggtggattgttgagtacaataccgtgctcgcagtccaggcgttcctttacggagtccagcgctttttttaccatgccttcttccagtccgatgcctgccatggtgcaccagccttgcgattcgatgaagatttgtccttcttcgttctctttggagcctaccttgtggccgaagtaatcgtaggcgcgcagataccagtctccgtcccagccgtgtttttttacggcttccaccatattgtctatgtaggtttgcgctctgtttgcttcgtcgtctttacccaggcggcggcacagctccacgtagtcgcgtccgcataccacgaacaagccggcaatcatcagcgattctgcctggctgccttccgtctggttttccgtggtctggaaggattcattcggatcccaggagaagcagttcaggttcaggcagtcgttccagtcggcacggccgatgaggggcaacatgtgggggccgaggttctcgatgacgtggttgaaggagacgcgcaggtgctcgaacagagacacttccgaaccttctttgttgtcgaaggggacgggctcatccaggatactgaagtctcccgattccttgatgtatgccaccgtaccgaagataagccacatggggtcatcgttgaagccgccgccgatgtcgttgttgccgcgtttggtcagcggttggtattggtggtagcatcctccgtcggggaattgggtagaagctatgtcgatgattcgttcgcgggctcgttccggtatctgatgcacgaagcccacgaggtcctggttggagtcgcggaaacccattccacgaccgatgccgctctcgaagaaagaggcggaacgggacatgttgaaggtaatcatgcactgatactggttccagatgttcaccatgcggtccagtttttcttcgtcggtcttcacgacgtagatgtccagcaggcggtcccagtaggctttcagttcggcaaaggcagcatctactttggcggtagtgtcgaaggccgaaatcatcgccttagcctttaccttatttataataggtgaagagggtacactctgcttgaacgcttcatgcagagattcttcacgttcctcgaactttgcctcctgcttgttttccacatagcccagcaggaagatgaagtcgcggctttcgccgggttgcagttctacttccagatagtgcgaggcgatgggactccaaccgtgggcaatgctgttgcccggtctgccttctactacccgttccgggtcggcaaactcgttgtagagtcccacgaatgtttcgcggtcggtatcgaaaccgtctacgggtgtattgacactgtagaaggcgtagtgattgcggcgttccttgtattccgtcttgtggtagatgacagacccgtccacttccacctctcccgtggagaagttacgctggaagttctccatgtccgtagcggcattccacaagcaccattcggcaaaggagaatagtttgagttttctcactttggcagaagtattccgcaaggtcagcttctgcacctctccccaggtcttcagtgggacgaagaagagcaggctggcttcgatgccgtctttggatccggtgatgcgggtgtagctcatgccgtggcgacactcgtaactgtcgagtgcagtcttgcagggcttccaggtgggagaccatacgttgccgccttcattgatgtagaagtagcgtcccccgttgtccatcggcacgttgttgtagcggtagcgggtgatgcggcggaacttggcgtccttgtagaaggaatagcctccggcagtattggagatgagtgagaagaaatcttcattgcccaggtagttaatccatggccaaggtgtcttggggtcggtaatgacgtattcgcggttgtcgtcatcgaaatatccgaatcttttgtcttgcatattatttcttgtatttagtttgatacattcttcattagttgtgccatccggccattttcccggaagcacgcttcaaatttaaaaacttttctcctatcacccttgtttgcccggcgtgttttttcccctcggaaacatgaagtaccggaaaatgatacaaaagtatcaccgcacgaatctttttcgctctatctttgtaaacacattttatgattaaccgatatgaaacacttattcgcatttctgttccttcttggaattaccttttctctttctgcccaatccgtccgcgaacgtattttgctggacgacggctggcagtttgcttttggcaatgcttcctcaccggagaaagacttcggctgcggaacggagtacttcaactatctgaccaaggcagcctctatccataacgagggtccttactcccccaagttcaatccggagaagtggggcgtggactggaagacggtcaaccttccgcatgactgggtggttgatttgccttatgccaaagaggcgagccacagtcatggttataaagccgtcggctataaattccccgaaaactctgtgggatggtatcggaaaagtatcactgttccgcaagaggacctcggcaagcatctttatcttcagttcgacggtatcttccgtgatgcccgtatctggataaacggtttctacctgggacacgaacccagcggctatgccacgcaggtatacgacattacggaatacctgaattacggagaagagaatcttatctgcgtccgtgcggatgccacgctcgaggagggctggttttacgagggtgcgggcatctaccgccatgtatggctgaacaagacggcgccgttgcatgtagctcctttcggcgtatttgtatcttccacgctggaagctcctttcgacaaggctgtgctggtgaccgaagtgcagatgaagaattcgggaaaagaccccgtctccggcaaagtatggtgccgtctgcttgatgccgacggacaagtgcagatggaggacgaggcggaagagataaccctgctgccgcaagaaacgcgtagcgtaaaggtgcgtaccaaagtgctgaatccccagctatggagtacagaacatccttacctttataaaatggaaaccagcgtctggcaaaacggtaggcaggtggacgtggtggccaccccgattggtattcgcgacatccgcttcgatgccgacaagggcttcctcctgaacggacagcctctgaaactgaaaggtgtgaacatgcaccaagaccaccccggagtaggtgccggcattcccgatgccctgcaagtgtaccgactgaaggaactgaagaagttcggctgcaatgcctgccgttcttcccataacccgatgactcccgaaatgctcgatgcctgcgacagcctcggcattcttgtgatagaggaaaaccgtctgacgggcgtcaacgaggaacatacccgcctgctgaaacgtatgatagaccgcgaccgcaaccatccgtgcatcatcctttggagcgtaggcaacgaggagtggggcatcgagtggaaagaaagcggtacacgcattgctgccacgatgcgcgaatattgccaccgtttcgaccctacgcgcctcatgaccgttgcttcgagcagtggccctgccatcttgattcccgcagacgtggccggttataactacatccttcagaaccctgtggagcagcaccgcaaggattatcccggtcgccgggcgctcggttcggaagagaccacgggctgtggtacgcgcggcatctactttgatgcccacggcaaaggccacatggtggcgcacaaccgtaaaccgaacgggcctgacagcctgctgaactgcatcgagcgtggctggaaattctatgacgaacgcccctatctggcaggtcttttctattggacgggtttcgactaccgcggcgagcccaaccccatgaagttcccggctacgggctcacaattcggcattctggactactgtggcttccccaaggacgaagcctggtatctgaagtcctggtggacgaatgagccggtgctgcacatccttcctcactggaatctgcaaggtcacgaaggtgatagcatcgacatttgggtatacagcaactgcgatgaagtggaactgactgtgaacggcaagaaactggatcgcaaaccgatgccccgaaacggccatctttcctggaaagccgttttccagcccggtgcagtgaaggctgtaggctataagaacggcaaaaaaatattggcccgtactgtggagactaccggtgctcctgcccgtatctccctgacggcagaccgtcccgtcattcaggcagacaatcgggatgtggcagtgtgtaatattgagttgcaggacaaaaagaaacgttttgtccccactgcctgcaacgacttgacgataaccgtttccggtccggtacgcatccttggggtggggaatggagaccccgcttatcaggctacggaacgtccggccgacgccgatgcccgcacctatcaggtaaaggcattcaacggacttgcacaggtgctgttgcaaagtaccggcgaagcgggagaagccacactgacggtcgtttcggaaaacctgccggaaacttcctgtgtcttgaagttgcagaagtaagcggcttatcatttatatcatccggcgaagcggagacctttctcttgtctatggggcaagagagggatctccgcttctttcttcctcaaactatagtgtgtaagtgtacgagatgcgcatctcatacatccttacattagagcctgagggggagaagaacggaagttttgcttttccgggtgggactttcccgggtatctgctcatatataacaattattacctctaaatgtaacaaatggtactgttgtgggattaaaaagaatgagtatatttgtggcatgatatttttttaaccaatgcctatggaaaaccagaactatatcatgagggaaataacccctctgtcggaacgtgactgtttctatattgccgatcgtcgcaaaacagaatttacctaccccatccattgtcacgcagagtatgaactgaacttcacggaacatgcttccggcgtacgtcgtgtggtgggcgattctgccgagattatcggtgattatgacctggtgctgataaccggtaaggagttggagcatgtatgggagcaacatgaatgtacctccggggatattcgggagattaccattcagttctctcccgacttgttcttcgggaacgttgtcaacaagaaccagttcgacagtatccgtcggatgctggagcgtgcacagtgcggacttagtttccccatgcaggccatcatgaaggtgtacaactggctggataagctggcttccgaggagcagggcttttatgccgtgatgaactttctccgtatcctttacgaactttccctctatgacaatgcccgggtgttgtccagttcttcgtttgccaagatagagactttctctgacagccgccgggtacagaaggtgcagaaatacatttccacccattatcaggaggatatccggttggcttcattggccgatatggtgggcatgaccccggtctctttcagccgtttctttcgcctgcgcaccggcaagacgctttccgactacattattgatatccgtctgggctttgccacgcgtatgttggtagattccacgcgtaccattgcagaggtgtgctatgactgcggcttcaacaatctgtccaatttcaatcgtatgttcaagcggaagaagggatgctcgccgaaggaattccgtgagaattatcggaaaaagaagctggtgatatgataaaaaagtattggtattcttcattgaaagtgcctatttttgcaccaatgattaatactaatatctgatatcatgaaaagagttttttccttatttttatgtctgctgtgtgtatgtgctgtgacggcgcagatacgcggcaatgaaatccgtgtagtcgtttcacctgaccatagcgattgggtgtatcgtctgaatgagaagtgtacgtttaccgtccgggtgctgaaggcacagaacctcttgtccgatgtcaagattgactatgaactgggccccgagatgtatcctactgaagtaaagaaagacgtggtgctgaaagatggtaccttgaagttgcaaggcacgatgaagactgcaggcttcttgcgttgcaaggtcaaggcgcatgtggacggccggacttatgaagggctggctacatcggcctatgctcccgagcagctgcaacctgtgacgaaacttcctgccgattttcgggattattgggccaagaccttggaagaggcgcgcaagactccgttgaatccccttatgacgctgcttcccgaacgctgtacggaaacggataatgtatatcaggtcagcttccagacaaaagcttggggaggacgtttttacggtattctcagtattcccaagaaagaagggaagtatccggctttgctgcgtgtgcccggtgcgggtgtccgcccttatgcgggagatacgtatacggctcctggaaaggtgattacattggaggtgggtatccacggcattcccgtcacgatgcagcagtctgtatatgatgcgctggcaggtggggcgctgagcaattactggacgttcggccgcgacagccgggatgcttcttactataaccgtgtggtggtaggcgctttgcgtgctgtggattttatctgttcgctgccgcagtacaacgggaaggcgctgggcgttacgggctccagccagggcggtgccttgtctgtgattacggcggctcttgattcgcgcgttactttcctggcggctgttcatcctgccttatgcgaccacgaagcgttcttcaagaagcgcgcttgcggctggccccattatttctattattacggtgctcccgatgaaaagcagcttgaaacggtgcgctattatgatacggcaaactttgcccgcctgctgaatgtgcccggttggttcagttgggggtataacgatgaggtctgtcctcccacttccatgtatgcagcctacaatgtgatttcttctccgaaggaactgcatccttatctggaaaccgggcattactggtatcaggaacagtgggatgaatggctggactggatacggagacaacttaatgtgccaatgtgattaatcacattggcacattaatctgataatatagtatcattttttatgatatgagccgcgtatctttgtgtatcgcttaaaaactgataatatgaagaaacaattccttttgctgacagtacttttattccttttgggggcatgtgcccctaagcctgcggagcattcgtttattaaggtcaatgccgatggacagttcgttcgcgacggaaaaccctattattttgtaggtaccaatttctggtacggtgccattcttggttccgaaggtgaaggcggcaatcgtgaacggttgcataaggagctggactttctgaaaagtattggcatcaacaacctgcgcgtattggtgggtgctgacggtgaaaatggcataaagacgcgggtagagccctctttacaagtggcaccgggcgtctataatgatactattttagccggattggattattttatgaatgaactgcgtgaacgtgatatgacagctgtcctctatttgaacaattcctgggaatggagcggtggctattccgtttacctgcaatggtccggacacggtgatgccgtggtacctgccgtagacggatggcccgcctatatggagtatgtcaagcagttcccccaatcggacagcgcgaaggccttgtttgccaatcatgtcaattatattgtttcacgcaccaataggtataatcagataaaatatgtggatgaccccactattatgtcttggcagattggtaacgagcctcgcgctttctctgacgagaacaaggaaccgtttgcccgctggatggccgatgtggctgcacaaatcaagtcacttgacccgaaccacatggtgtcttccggcagtgagggctcgtggggatgcgaaatggatatgaatcttttcgagaagattcatgccgaccccaacatcaattatctgaatatccacatctggccttacaactggagttgggtgaaggcggacagcctgaaggaacttcttccgcgtgccaaggaaaatactaagaagtatatagatgaccacatggtcattgctcggaagtacagcaagccgattgttttggaggagttcggttttccccgtgacggtttcagcttttccaaagaggcaccgaccactgcccgcgatgaatattaccgttatgtattcgacctcatccgccaggaccgtgagagcggcggactctttgccggatgcaacttctgggcatggggtggttttgccggacaaaatcccgaccatgtattctgggaaaagggagatgactataccggtgacccggctcaagaacaacaaggactgaactctgtctttgccacagacagcactattgaaataattaaagcggaaaaccggaagctgcaaaattgaacctatccgtgcttttccgtgtaatccctgcctgaaaattagaatgtaagcgtgtacaaagcgtttgtaccgttatataagaaagattattactctaaatactaagtatgatatgaaaagcatatggaaagttatgttggcggtttgttgcctaggtatgaccattggttgtggaacaaacccgtcgaagaatgaaaatgtaaaggaaacgctaccggcattggtggtcaatggtacgcagttgatgaataccgaaggagacacggtggtattgcacggtgtcagctatggctggcatcagttctggccccgtttctacaatgcctcttcggttgcttatctggtcaatgactggggcgcacaagtgcttcgggcctctatgggagtggatttggatagcgcctgctatgtgaacaagcccgaattcggtattgagtgtgttacgaaagtggtggatgctgctatcgagaacggcgtttacgtcatcatcgactggcatagccacaatctgcggcaggaagaagcaaaggagttcttcacccaaatggctacccgttacaaaggggttcctaatgtcatctatgaggttttcaacgaaccggtggaagacagttgggagcaggtgaaggcatactctgtggaggttatcaagacgattcgtgccatagaaccggatgccgttatcctcgttggttgtccgcattgggaccaggacatccatttggcagcggacgatcctattaccggatatagcaatataatgtatacactccacttttatgccaacacccacggacagtggctgcgcgaccgcgccgactatgctctgggcaagggcttgccgattttcgtttccgaatgcgccggtatggaggcaagtggggacggccccatcagtaaagaagagtgggggaattggctggactggatgcagcggcattccatcagctgggtggcctggtctttgtctgacaaggatgagacttgctccatgttctatccgtcggcttcttccgagggaaactggaaagatgcagatatgaaggaatggggaagaatggtacggaacgaactgaagaaatgaccctttcgggaaaaagcaatatgatttaaccattaataatttaagaaaaaaagaattgtgcctatgggaaaaaaggaaaaacggaactatgaagacatggactgtttggaagtaaacctaaatgtcaaggctgtgatagtatatcagggctttttgactcagtctcatttttgttaactaaaaaaatcttcttttgggaggttttgtgtttgttttaaatctaagaaatacagtatgaatttgaattttagaaagacagcgctgcttgcggggatatgctcggtgttcagtctgggttatgccctcagcttttcgcagtatcatcgacggataccgttgaggcagtgcagcaaacaaagaaaattacgggtgtcgtcagtgatgctatgggccctattatcggtgccaatgtattggaaaaaggtacaacgaatggtgtaattaccgacattgacggtaactttgccttgaatgtgaaaccaggagctaccattgtagtctcctttataggctatgtcagccaggaaataaagataacgaaccagacaacagtgaacatcacgctgaaggaagactccgagatgttggacgaagtggtggttgtggggtacggtacgatgaagaaaagcgacctttccggtgcttccgtttccatgagtgaagacaagattaagggttctattatcaccaatctcgaccagtcccttcaagggcgtgctgccggtgtgacggcagtcagcacttccggtgctccgggttcttcctcctctatccgcgtacgtggtcaggccactatcaatgctaatgccgagccgttgtatgtaattgacggtgtgattgtacagagtcagggacaaagcggttcatcttatggtttgggcgatgcactgggtaatggctcggtttccaccatttctccgctttccaccatcaaccctgctgatatcgtcagtatggaaattctgaaagatgcttcggcaaccgccatttacggtgcgcaaggttccaatggtgtggttttgattacgaccaaacgtggtaaggcgggtgaggctaagtttacttatgacggtatgtttgccgttcaacgccagacaaagcgtctggatatgatgaatctgcgtgagtatgccacttattataatgatttggcaaacatgggtgaaatctctgaccctagtaattattatgccgatccttctctgctgggagtaggtacaaactggcaggacgccatcttccagactgctttgcagcatcagcaccagatttcggcacaaggtggtacagagaagatacaatactacgtatcagcttcctatatggatcaggacggtaccatcatcggttcaaactttaaccgttacagcttccgtgccaacttggatgcccaactgaagaagtggttgaaactcggtttgaccgccacctatacagcaacgggtgatgacctgaaactggcagacagtgatgaaggtttgattaactactcgttgaccactcttcctgatatacctatctataatctggatggcagctatgccaccgttgttcgcgaaggctacacgaatcctaacccgattgcccttgccatgatggatgacattctgctggaccgtcagaaactgacgggtaatattttctttgaggttactccgattaaaaatctggtatggcatgccgaattgggttatgacatcagttccagcaaaggtgagcgctacaagccgatggttgatttgggtggatgggtacgttccagtaatgaaagcaatatccagaaaaacagcagtacattctggcaattgaagaactatgtgacctattccggaaacataggcgacaagcatcattatacagccatggtgggtcaggagtgctgggagtccagctatgacttcacgagtgtgttcaatagcggtctgccttcggatgaagtgcacaatcctgccttgggtacgggaaccccgactatcaatgcaggttttggaagctcgtctatggcatctttctttacacgtctgacttataactatgccgaccgttatctgggtacttatacctatcgttatgacggctcttcaaacttcggtcccgagaaccgttgggcaggcttccattcattggctacttcctggcgcttttccaacgaaacgttctttgaaccgttgaagaaggtcatcagtaacggtaagttgcgtctgggatggggacaaactggtaatgccaacatcggtggttatgcttggggtacatccatgagtcgtatgccttccggtctgggtatggggtatcgcccctccaatataccgaatacttccatcaaatgggagtcccaggagcaatggaacgtcggtgtggatttgggattcctgcacgaccgtatcaacctgacggtagagtggtacaagaaaacttccagtgatatgttgatgccgttgcagttgccttcttatatgggtacttccggtaatgcctcttctgcattggctgctccgaaaggtaactatggtgacatagagaataccggttttgaaatctctctgaacacacatcctattacgggtaagtttgaatgggattctgacttccagatttctttcaacaagaacaaactgaaaggattggctggtacagccaatgcgcagattgtgggttacggacagtggaccgatgtagtcagtgtatccagtgtaggcgaatcactttataacttctatggatttgtttgtgatggtgtttacaaggacctggaggaccttcagacttctccgaaacctgccaagtacccggcaaacggtgtattcgaccgtaccaataccgtatgggtgggtgatgtgaaatataaggatatcagtggtcctgacggtgtgcccgatggcgttattgacgactatgacaagaccaatatcggttctccgatgcctaagtttacttttggctggaccaatactttccgttacaagaacttcgacttgtccgttttcatcaacggttcctatggcaacaaggtgtataactacctttccatgaagctgacacatatgaactctccctggactaaccagctgaatgctgtaaacggacgtgcacagcttgttcctatcaatccgaacaaggtctacgaagatggaacgatgtggtataatgatgtgtctaacgtcatggtggcaaacccgggagcttccattccacgcgccactatcaatgacccgaatgacaacgaccgtatcagtgaccgttatattgaagatggttcttatatccgtctgaagaacatctctttgggatatactttcccgaaaaagacgattgataaactgggactgagcaacttgcgtatctatgccaatatccagaacctgctgaccattaccggttatgacggctatgaccctgaaattggtgccagcacttcaagcgtcaatgtctatggtttggacaacggacgttatccgtctcctacagtttattcattcggcttgaacgtttcattctaacactttaaattgaagaaaacatgaaaatcagatatattaaatattgggcgtttgcagctgtactcggtatgggaacagtttcatgcgaggatttcctgaaccgtcctaccgaagacaattataacgaatcgaacttctatcagaatgacgaacaatgtgtgcagggggttaattatctttataactcaccttggtatgactttcagcgcggttttattaaagtcggtgaaatcttgtctggaaacgtatacgagggaaacagcccttacttgaattttacggtgaatggtacggatgaaaaccttgtgaacatgtcctattctctatgggcagtgattggccatgccaatactgtatatactcgtttgaagacggcaaatgcgtcagaagcagtgaaaaatcagtgtatgggcgagtgtctggcatggaaagccatggcttacttctatttggtacgtagttttggcgcagtacccattatccatgataatacggacgaattgaattccggtaattataactccaaattcaaagtggaggcagcagatgtgtacgaatatatcattatgactctggagaaagctatggagttgcttccggccagaggtgaaacgggacgtattgaccgctattgtgccgaaggtcttttggctaaggtgtatctgactaagagtggcctttccggtacccgcaatgcggatgatttggcgaaagcggcagaatattccaaggatgtaattaataattccggccgtaacttgctggctaactattccgatgttttccgtttggcaaacaacaagaatgaagagtgtctcttctcctggcactggtcggcaggacgtgacccctggacacagcagaatacgttgcagtcggacttggcaatggtgggattcgatgaatttggtgattgctggggtggctatgcaggtccgtcggttgatttgcaggatgcatttggaatttccgctttggaaagtcctgagacgcgttcggatacggatacccgtcgtaaggctactatgatgatggcaggtgatgtatacgattatttctggcaggacaagggcggatttgattatctgcggtttatttatgatgccgaatatggtaagggaggacctaatggcgattaccagtctcctaccggtgccaatcacgtgaagcatctctatggtaacaataatgaccatgtattgggcttgggcgtatcggctggtaatatgtacagcggcctggcaacccatatcctgcgcctgtccgatatctatctggtatatgccgaggcgaaaatgggactggctacctctactacagaccagagtgcactggatgctttcaatgcagtacgtggccgtgccattccgggagttactccgaaaacctccattacttgggaggacgtctggaaggaacgccggctggaactggcttgcgaaggcgaccgttggtatgattatgtacgtttggcatattatgattcccagcgtgctatcaatgagttgaaggcacagcgccgtgatgtttattatagtctgggtactacttataaggcttattatgaaaacggcagttggacggtgaatccggacgagacccgttacaatccggatgcaaaggcgccgaatgtgacagtctccagctttacattgccgttcccgacagaagacgtggtgttcaatcctaatttgatgaaagacccggtacacgtagatgtacgttctgaattcagttattaatttaatgcttgaaaagatgaaaaataatagatatacgaattggttcttcgcggcagctgttgttgtagcaggcttttccatggcggcttgtgaggatgaaccggataaatatgaagtggcagggggaaagcctaccttgaaatatgttcgtgtccctgatccggcagcggcagactctttgctgacgggggcttatatggcgaatacgatttgtctggtcggtgagaatctgcggagtgtttacgagctctatttcaatgaccagaaggcgatacttaataccagttacatcactgaccatacacttatggtagatgttccgaaagagattccttcggtagtgactgataagatttatatggtgaccaaagcaaaggataccatagattatgatttcaaggtgttggttccggctcctaccgtgaactccatttcttgtgagtttgcaaagccgggtagtgaggtgacactgattggtgactatttcattgatgacccgaatgtgccgctgaccattacgatggccggtaatgtggaagtgactaatattacgaacataaccaagactgcggtcagctttattcttccggacaatgctcctgcaggctatatcaacgtgaagtccatttatggtaccggacgttccaagttccgctattatgatacacgtaacattctctttgactgggacggttctcatggcggtatggctattgcccacggttggcgtgatggtagcaaggtgttgagagaagccgatgaaaacagtattgacggtgcttatatctgtctcaccggagcacttgacggtgctatcggagctacttgggcagaagatgagttctcgttcaactattggccggaaccgtctgccggttatcccgaactttctgcacgtcctgagtttgcagaactgctcgaggagtatggcgtcaatggcttacaactgaaattcgaggtgaatattccttcttccaatccgtggcagtcttgcgctctacaagtgatgtttacgggtaatgatgtggtgacttatgcgacgggaactaatgcttattttagtgatacgaatgtgccgcgcggtttgtggttgccttggaagaatacgggttcgtatgatacgggtggtaaatggacaaccgtttccatgaatctgtccgagttcaacaagacgcatgaaggtaataagtgtgatagaacttttgacaagactatgctgaccggattgacattctttgtctgggcaggtggtgtggaaggtaaggattgcaatccggtgattatgattgacaacatccgtgtggtacctattgaataaccttttaaatagaatactgatatgaataaaacatataaatttccggcactgtggatgatgtgcctgatgctcttcagttgcttgacgtttacggcctgcgacaatggggatgatgaagataccaaccaatataaagggggaatcagtctgaatgtattcggaccgagtcccgtatcccgcggcggtgtactccgtttcctaggcagtggcatggataaagtgactgcggtcgctattcccggttgcgacgatataacagacatcgaagtagtcagtgatacggaaatccgtgtcactgtacctcagacagcccagccggggttggttgtcttgaagactccgaaaggggatattacaacaaaaaccgagttgacatttacggagccgattgctttggaggcttttgcaccggcagaagtaaagcctggtagtgaattgaccattactggtgaatatttgaatttgattaaagaagtgatatttgctgacgaggtaacagtgcctgctgatgagtttgtcagtcaaagccgtcaggagattaaagttattgttcctgattctgctcagaccggtaagttcatcttgtctgatggagctgaaatccccaattggatttattctgaaggggaactggaggttactttgccatcggtagaggctccactcgacctggtagataagaagccgggggatgtcattcgagtttctggtgaaaactttgatttggtgaagaaagtgcagatgccgaatggggatgaagttgaatttacgatgactgcctcttccgaaggagatgaacttacttttacattgccggataatgtctcggacggagaaattacggtacttcctgcttcggatgtaaaagttgtggttgctactgttgtagtagctacgccttcgaacgtagtggctgttcctgctgtgaacttgcgtggtggagatatgattaccttgaaaggtaccaatatggatttggtgactgatgtaacgttccctggtgtagaagaagcagtaggattggaatcacaaaactcgactgaaataaaggtcttgatgccggctgcggctattagtggtgatttgcaattgaatacaaatagtggaaaagcaactgccgtatctattgcaacggcaaagccggaaaacatttcttatagtgcggcgacagtcccggcaggagaggctttgactgtcaaaggagtaaatatggatgtagtttcggctgttgtattcagtggtaatgtggaggttaccgtatccgatgccactgctactgccatttctttgactgtacctacaactgccgaaactggggccttacttttgaaaatggccaatggtgaatttgtggaagcaccgtctctgacaatagagaaaccggtatgcgcctatttgccggcattgcctgacaaattggttcggggacgaattgtggaacttgagattgttaatgctgataaactgacaaatgtattgctgaatgaggcttcagtccagtatatcaatgatgcggctaaaggggtattgatgttgaatgtaccggctgaactgaatggaacttatagtctgaaactgatttcttcaaatggtgaaattgcttatgatgttcttgtggttgctaatgaagaaacagtttgggctggtccgctcgatattagttggggtgatggaggacgtgtgttggtaccggctgtatcttttgccaaggtaacggcaggcactgtcatgaaagtctatttcgatcagaaagaccagacttgggcacaggctcagtttaactatggcgattggagtggcatagctttctctttgtttgatacgactatggtaccgacagacatttacggctggagtttcgagagccgtgtgatggagttgacgttgactcaggagatacttgataatattcaagctaaacaaggagattgtgaagaccagacaaatgtaggtatcattattcagggcagtgatttgacgtttacaaaaataacgattgtaaattgatgaattgtggcttgaagaatgtgactatggatgccctgattaagaatgaaataaaatcataattaagatgaagaaactgaatataaaatggatgctttcgttgatagcagcttttacttttgcctcctgcgatactgatgtcgatcatgatatcccagcagtggatgcaccggtattggtgtctactactcctgaaagtggagcagccaaagtgaaaacgggagaaatcactattgaggtgaaatatgacaagaatatattctttgcaacagacaatctgagcgaaatcaagtttaccggtggtgaactgataagtgccgatgtacttggcgcaagcaatatactgactgtaaaagtgaatgttcccgggagagagacggcttgttctctctctatccccgagggaatagtaaccggaccgaaccagatgcctgctccggctgtatcggttcagttctctactgtcgctttggacaaggcactggttgccgctagttcggccaaagctgtgaaactgtacaattatctattggataacttcgagacgaagacactttcagctatgatggccaatgttgcctggaatacggaaatgtccgaaaaggtgtatggatggactggaaaatatccggctatcaactgtttcgactatgttcatctgccggcatctgtagctggagcagactggattaattacggtgacattactcctgttaaggattggtctgacaaaggtggcatcgtagctgccatgtggcattggaatgtacccaagaaagctgtaggcgaagcttcttctacccaaatatgggaaggagagacagtaatgccgggtgattggagtggaaatgtacagatgacggatgatgctgcaaaagctgtctttgctgatgcacaagtgggtcaggtgatacgcgtggctgtgaaggatgtggcagcgggtgcacaaggttcgttcaaaaacagtggttggagcgagattgcttcaggaactgattattttgacatatccggggactatacattggtgattaccgaagatgttttgaaatccctgcaagaaggtggtctcatcattggtggacatgattatacagcagttgctgtttatcttgaaaataacggtacagctctcgacccgaataaggattatgccttttataaggcagatacggagtttgatgctaccaatgccacagtggaaggcacttgggaaaacaaggtgtttaccgaagatttgaaaaatgctgccgcttacttgaagctattgagagatgcggatattccggtattgtggcgtccattccacgaggcagccggtggctggttctggtggggtaaggatgctgccagctttaaatctctgtggattgctatgttcaattacttcaagactgaaggattggataatcttatctgggtttggactaccgagggcaatgatgccgattggtatccgggagatcaatatgtagacatcgtgggacgtgatgtttataataaggaaactgcagattgtgtttcagaatatacttccattgccgaaaattatggaaacaagattgtttcgctgagtgaatgtggtacggtcggacttatttccgaacaatgggcatctggtgcacgttggagttggttcatgccgtggtatgacgggacaaatgaggatggtagcccggtagtccatgctgatgaagcatggtggaaggatgctatgagccaggaatttgttgtttcccgtgaagagcttccttctatggaatagcaatttttaataataaaatagaaagggttgtctctggttagtatcggggcaaccctttctgtcttttatagcttttagttgttggttatagaattcatgctttatactttttaggaaaaatagtaatggatgttaaatgagtgtcgttatttgataaaatagtattataaggtttgctgctaaaagtctacttttgtcaagcctaattaaaatttgataataatcatataatgtttaaccgctaatgaaatgaaaaatgcctatgagaaaggagtgatatgtataccaaccactttatagaataaggtatatttaatttttcctcaaaaagagaagtttaaccttatattaaacggtagatgccgccaggcaataccaattcattaatctaagaaaaatacaagtatgaatttaaatttcagaagaaccgcgctgctcgtgggtatctgttcggctgtcagcctgacttatactccgcaacttttcgccgcatcggtcgatgcaatagatgctgtgcagcaagcaaaaaaaatcacaggtactgtaacagatgcaatgggaccggtcatcggtgccaatgtattggagaaaggaaccacaaatggtgtcattaccgacattgacggtaatttcacattgaatgttcagccgggagcaacgattgttgtgtcttttatcggttatcagccgcaagaaatagtggtaggtaaccagactagtttcaagattcagctaaaggaagatacggaattgttggatgaagtagtcgtagtgggttacggtgtacagaagaagaaactggtgacaggtgctacggttgaggtaaaaggcgaagacatcgcaaaattaaatactacgcaggcattgggcgctttacaaagccagtctccgggtgtaaatattcaggccgtttccggtcagccgggtgatgggtttaaaattaatattcgtggtgctggtactaacggaaatacagctccagtttacgttattgatggtgtagccggtggcgatattaacgccttgaatcctgccgatattgaacgtattgacgtgttgaaagatgctgcatcttgtgcaatttacggttcgagcggtgccaacggtgttatccttattactacgaagcagggtaaggtaggaaaggtttctgtatcttatgatggaaacataggttgggcaaatatatataagatgcctgatatgttgaatgccaaagaatatatggcggtaatggatcaagtggcctataataatggaggccaaccgtatgattggtcaaaattcgtagatgctgatttgctgactgcttatcagaatggtaccaatcctggtacagattgggtaaaagaattccggaataaaaatgctgtggttactaatcatgcgttgaatgtaacaggtggttctgaattctccaaattttcgacaggtataggctatcagtatcaggatggtgcattcggtggtccggtgaagactgactatcgtcgttttactttccgcattaattctgagcatgtgatatatcgtaagggagatgtggatgtgataaagtttggtgagaatatatattatcagcacaaacagaatcaaggtgtgcagttaggtaatcaatattcgaatgacctttctaatgctttgcgtgctattcctctgattcctgtatataatgaaaatggtgatttcttcatgtatgatgatttgaagaattttggaacgagtgctaatggtatacttgattatactgcatatgcttctaatccgatggctcacatggtatataatcaggctgggaataataagaataagaattttaatctgaacacagcggcatatctggaagtacaaccacttaagaatcttatttataaaggtcaggttagttacaaacaatggtcaagttcatggcgttcatatcttcccgtttaccaaattaataatcagggagatagccgtgataaagaccaaacgataaataacgtgtctttgggttggaactggagtttgactaatacgttgagttatcggtttgatattacagacttacatcattttgatgttttggctggtacagagtattctaaatcaagaccaacttatggcgaatcagtagaggcaaccggttataatagtacttttggtgactttacacatgcttatttgcataatacagaacgtaaagctactgctacagtaaatggttatccctcggattatggttctaagatgtcttattttggacgtttgaattatgactttaaggaaacttatatgttttctgctatcattcgtgccgatggctcgtctaagtttgcgaaaggcaatcaatggggatatttcccatcattctctgctggttgggttatttcaaacgaggcttttatgaagaatactgcttcttggcttggtttcttgaaagtccgtgctggttggggacagaatggtaatgacaatatccctaattcaaattggcgtgccagttacgagtttggcgattatggtctttatacatttggctcggataagaatggaggtacaaccggagcttacccgaatcgtttggctaaccccgatttgacatgggaaacttcagaacagaccaatatcggtattgatgcccgtttcttggataaccgtctgagttttaccatggactggtatagcaagcagacgaaagacttgttagtggaagtgggtaccaatgcggcttccggtttcgctactcaatatcaaaatgctggtacggtaaagaatactggccttgaactttcaatgggctggagagatcagattggtaaggagttcaagtatggggtgaatgtcaatatggcctataataagaatgaagtaacggaggttaataacgccaatcattttattgaaggcggtaatgatttgttggctcaaagtacgggtcggtttgtccgtatggaagaaggacatcctattggctatttttatggttataagacggatggtgtcattcagaaccagaatgacttgcaggcatatcttgaccagaattgtaaaggaaatgcggcaaactctaagcaaggtgcaagtattaaaccgggtgatttgaagtttgtggatgttgatggaaatggggtgattaatgatgacgataagactgatttgggtaatcctcatcctgacgtgacaatgggtcttacgttaagtgcggaatataaaggatttgatttctctgtaacaacctatggcgcttttggtgcacaggtagctcgctcttggcgaaagttctcagatggacagtatgaaaactatacgacagaagtttacgattactggcatggcgaaggaacctcaaacagatatccgctgcttgcgccgggaaatagtggacagaatttccaggccatttcagatatttatattgatgatgccgactatgttcgcattcaaaatctgactataggatacgatttcaagagaatttggaagaactgtccgttccagcaacttcgtgtgtatgctgctgcacagaatctatttacttttaccggttataaagggatggatccggagaatggtagagccctcaatgacaaagaaccgtgggtaaccggtgttgatgtaggtaactatcctcaacctcgtacttatatggtaggtgttaatgttaaattctaaaattgatacacgatgaaaaaaatagcatatttaataggtgcagctttgatgatagcaggaatgtttgcttcttgtagcttggactcgatgagtctgacggaaaaagatacgaccaattttcctaaaacggctgaagatgccaatcaggctttagctgccatatatcagaacctgaataatgtcaatgcttttccacagcagtctttcttgtataattctctgctggcttgcgatgatatgttgggtggtggtggtcccaatgataagttgatgcaatctttggaccttatttgtaatacgggtacaaatgctacgcaggactactgggtggctcgctatcaaggaatcaaccgtgccaatacgttgttggaggctcttgctggtattgaaatggatccggaagtaagagcgcaggctgagggcgaagccaagttccttcgtgctttttattactacgagttggcttccatgtatgggcgcgtacctttggtgattactgctttgttgcccgaagatactactcctccgactgccgctgttatctgggggcagattctgcaggatcttcgcgatgcggctgcaaatatgccggctgttcgcaagtcggatgggcatgttgataaatatacggctgaagctatgttaggacgtgcttggttgtattatactggtatgtatggcaatggtgaaactctgaacgatttggttagtacgaactatagtccgttgacttcagttgatttgcctgatgggacaactttgaccaagcaggatgtggttgggtatattgatgattgtgtgaataattctggttatagtcttgttcctgagtttcgtaatttgtgggcatataccaataaatgtacggtagaagattttccgtttactgccggtcagggattgaagtgggtagaagatgatgcagcggtaaatcccgaatccatgtttgccattaaatataataaacttgcatcttggagcactactatcggttatggtaacggttatgctctgcattttggtgtacgtggcaatgatcaggccaattctttccccttcggacaaggatggggtgccggtcctgtagctcccaatttttataatgattggagtgtggcagaacaagatgatgcccgtcgtccggcctccgtattcaagacggaggatatgccgagttataataaaggtggtggtgacggctttatccaagaaacggattattatcagatgaaaataggttctatcatggcttatagtacggatgcggctggaaataaaacgattgagccggtatttgagaagataatgtatggtgccgacggctggattaatgataatctgatgcaaaccggttctattcatgatttggttttgattcgttttgcggatgtattgttgatgcagtctgaattgaaggaagatgtttccggtataaacagagtgcgtagtcgtgccggacttgaacctattggtacatattcgttggctgcattgcagaatgaacgccgttgggaattatgttttgaaggtactcgctggaacgatattcgccgttggcatattgctgccgatgcccttgaaagacagacgggagcaaaggtttatacaaatggggctgaaagccgtaatgtggcgcagaacggtggttatgccgcacgttataaggctacggcaggtttccagaagattcccgaaaaccaagtcctcctgaatgaaggaaaggtagaacaaaatgagggttatacggatgcaagtgctgagtataatggttggcaagaatagaatatgaatttaaaatgaaaaaagatatgaaaaagatattattcgcaatacctttgtttgcaatgctgctggtggcttgcgatccgatagtggatgaaatcagtccggatcccaatgtcacaccggaaaatcttacttttgaacttgtggccaagaaccagggaaacaacaacattcagattgttcctactccgtcacgttatgtgaaggtttatgatgctacgtctgatatcaagttggcagaaggtacggctccgtcggttcaagtagctcctcctaataaagaattgcaagtatatgtaacaaccattaattcggacggctccataacaaaatcggcttccaaatcaatagcagtaacggagtatacagatcttcccgctatttatgctgatgtattcggcacaactccggacggtggttatggaacaaccacttgggtctggaatacagaagctgcagacggttgttggggtaatggaggttatctcggcaataccggccccggttggtggatttgtgatgctgtgggagatgtcggaaacggtagagggcaaattgatgaacaagctgtaggaaaaggattgcctgatgatggattaaatggttggttctcacttagtttgactggtgttcagacaagtcgtggtgaaagtggttctgtcaaggtgtcagaagatgtggtgcaatccggttgggatgtaggtactatggagttctctggtactattccattgttaggtatacagccgaatcaaggaaatgcacgtcagtatgagtatcatattttgaagattacagaagatgaacttcgtctttgtgctcctgaacccggtgctggcgcttggggtacggcatggttctggaacttcaagaaaaaatagttaatattgaaaggtacgggtgggtaacgaccactcgtatacttttattactaataaaaaaatgcaacaatgaaacgaactttctttttgatattactgttcttctgtgctctttttgttaaagcggatgttttgggaccgtatacaatggatagtaatgtacctcccacaccaaccggatatgctcgggttgtacttccgataggaggtgctgacgcttcggtagccgtaagcataactgtttgtgacgaaagtggtcaacagtatgttttgagaactactaccccaaatgctgctccatattgttatttcttggcttatggcgtttaccgcgtggtcgctttagaggattgtacagcacaatctaattggggcgcacttacggttggtacaattttcgaagtgacaggaggtggctatatttctttaaattatataggaacaatctctactccaagtattgttcaagcatcgggtactgatgataatgttcctccttccaaagtaggttacaatataatgaaagtgtatggaatagagacaaacggcggtggggtgttggttgattctgacaaaaaagaatatggtatctttaattataccggacatataggcggtgctcattacttttacattaagccaggcacatacactataaaatctttgagtgctaccaatggaaattatatttatttggagtatggaaatgttagacaaccgctttctgctggtaggactttcacagttcctgcgtcattcttctccattgtgttttctaaaaaggcactttaagaataatctataaatgaattattcaactcaaagcagttgtcgttacccccccgactttattagtcgcccgtaacatcggataattgtaaatgcattaaccgaatagtacaattgtttaatggttaaatcaggaaaaggcgagtcgtgagattcgccttttcgcattcattctctattgcctttccggatgcaattcacattcctttttgtattacccctgatttcagggcgcagaatgtttctttttatccctgcatctccttcacctccttctcccatcctcctgttcattggctttcccggtgaaaccgctttccaccctcatcgccccgcctttgcatcgcgcgacacgccgtagtatcccggcatggcccggtagatgggttgcgtgggcttccccacattcttcagcttgccctcttgctgcaaccgtttcaggtggacgttcgcggtggtgcgcgccatgccgcagagcgcttggaagtcactgcgaatcagcacgtcgtggtcggcaaagtattctttcagcttcatgtctatctccacttccgaaagcttcagggagtggcgggtgtatttactgcggatggcattgactcccgtcatcgcttgtttcagcctgacgtcgggacggaagctgatgcttttcagccggagtttcaggtgcttgttcggggtgctgcgggtcactttctgtgtggcttccagggtgggggcgaagtagcccagcccttcgatgtgcacctcgtggccgtcgcgcagttcttcgccgcaaatttgcgccaggcagtctatcgcgttcatcacgtcgcccaccgtgagcgagctgcgggcatgcacgcggttgtagagctgccgcatggttactttcccgttgagcaacgggcggggatggaggcctctctcttcaggggcttcctcattagtgcccggattctcgtaccagtcatatagtattgccatatcaataggttttagtgcgttcaacatacttgtttcttccctcggaagtgtcttcctgtaagtgaacgactccggtcggccgaacgaataacccgggtcgttcgattgaacgacctaagtcagtcgattggacgacccggggcgttcacttataaagaaccgtgcaaaggtactgaaaataaagggttccgaagcataaataagtatgtttgtcggcaggaatgatttttgaagaataagcggagaatggtttgcaaaacgccctcggcaggcagtaactttggcgaagaggcgagaggaaagaaaggatgattcccttcctcgaaacctcccaataatcattttaataaaaaatatttatgaagaaaaaactgatgactttgcagcaacaccggctcttgaaggaagcgggacaactgatagccttttccgaaaggctgaaacacgcacaaaaagaaacgaccgaccgaaactggaaggagcgggaagagcagcgccgccggagcgcgaaagccgcaagcaccgtgactgcactgagcggcgacatcgaggagttcctcacttcgcgctacgactttcgctataatctgctgacggatgaaaccgagttccgccccgccggacaacgctctgccgccttcacccccgtgggcaagcgcgagttgaacactttctgcatcgaagcccatgccgaaggtattccttgctgggacaaggacttgaaccgatacgtctattccacttacatccctgcctaccatcccttcctgctctacatggacgaactgcccgattgggacggcaaggaccggctgactgcgcttgcctgccgcgtctcttctcggcctcactgggtgcggggattccatacctggatgctgggacttgcctcgcaatggatgggcgtgtccggactgcatgccaacagcgtggctcccgttctcgtcagccgcgagcagggacgacggaaatccagcttttgtcgcgccttgatgcctgacgtgctgacgcgttactacgccgacaacctgaaactgacctcgcagggacaagctgagagaatgctggcggaaatggggctgctcaatatggacgagttcgacaagtatgccgacaacaaaatgcccttactgaaaaatctgatgcagatgtcggtgctcaacatccgcaaggcctatcagcagaacttcaggcaactgccccgtatcgcctcgttcatcggcaccagcaaccggttcgacctgctgaccgaccccaccgggagccggcgcttcctctgcatcgaggtgaagcacaatattgactgcataggcatagagcacgaccagatttttgcccaactgaaagcggaactcattgccgggcggcgcaactggttcaccaagccggaggaggaggaactgcaatggcataacgaggctttctatcgtgtcagccttgtggaggaggcagttcacagcttgtttcgtgccccgcttccggcagagaagagcttcgatctgactgccgccgacatctttgatgagttacaaaaaacgcatcccgccctgatgcgtggcagcaatcccatgcagttcggttcggtgttgctgcgggtgggactgaaacgccggcatacgaagtacggcaatgtatatgaggtggtgagaaggaagaaagaagtttcaccggaaagggttgaacgatagggaaataatgcgaaaggtgaaggggtgaaggaagagaaagccggtttatagtctcattacggattgacatagattcctattaattcaggttgtagatgccgatgggataaatattttcgctcataataactgtatattttatagatttctataaaagtaacttttttataagaacaaaacaagcgaaagttgcgattttcactactccttgtcggataaaaaacttatctttgcgattgaaacaatctcttgttaatgatatgaaatacacatcatactcttatccttcaggcagggcggaagtggctgcatttgttgtgaccggcggagtgacggaataccatgtgatgatacatgccactgacccgaaacagacctatcgtgaacagatgaatgtcgtgttggatgcgtatgccgctttactgaaaaaagaactgtccggagccgtggcggtttttaaaagatacttcctgagtgatgccgccaaccaagcggaactgttgcttgccgctacggcggaaagctccgattgcgcgctgtctgtggtggaacagcctccgctggatggtaccaagattgctttgtgggcctatctgcagaccgatgtgcagacacgagtgttgccgaacggactgtatgaagtgaaacacggtgtttaccgccagctctggatgggaggcagcttcaaccgtgccgccaattcggaataccagatgcgtcttttgctcaacgactatgccatgcaactgatggaagaagggtgtaccttggccgacaattgcctgcgtacctggatatttgtgcagaatgtggattgcaattatgccggtgtagtcaaggcacgcaatgagatgttcgtcacccagaacctgacagagaacacgcactatattgccagtaccggtatcggtgggcgtcatgccgacccgaaagcattggtgatgcttgatgcttttgctgtagcgggattaaagcccggacaaatcaaatatctctatgcccgcacacacctgaatcccacttatgagtatggagtcagtttcgaacggggaacggcggtggattacgacgaccgtcggcaagtactcatttccggtacggcgagtatcaacaaccgtggggaagtgatgtatgccggagatgtacgccgtcagacagaacggatgtgggagaatgtggaggctctgctgaaggaagctgactgcggctttggagatgtagggcatatcattgtctatctgcgtgatattgcggattatgctgtagtgaaagagatgtttgacaagcgttttcccgatacgccgagagtgattacgctggctcccgtctgtcgcccggggtggctggtggaaatggagtgtatggcggtgaagaaaatctctgattaaaaatattatctttggttaattgaatattaggctgacagttggtaaacgcctacctttgttgaaattctaatgtataaggatgaaaacacgtatcttgcttttctgtatcagttgccttctttgggcaagttgtggaaattccggacagaattatgtgattgaaggaacgttgccgtcggtgaaatacgacggggaatggatatacctcgtgccgatggagaatgcgccggggcgggtggattctgtaaagataaccaatgcctctttttctttttccggacaaggggaggagatgagggtgttgcgtctgcgccatctgctgcgtatctacatccaggaactgctggtggtgacggagccgggaaccatacatgtgaaggccgactctgtcggttcggtaacgggcactccgcaaaatgatgcccttcagaaatggaaagaggggagggaaaagaagcaagaggcttaccattttatccggacgggactacggaatgccaccggaaaagattcactgcatctgatacggatacgtgacagtctgaggatgcaggagcaggaaacgaactttctgtttttgaaagagcagggaaacaatacgttggggacattcatgcggaagatggtgcgtggctccttgacggaagaacaacaaaaactgttggatgaaagcttgcagaaggaaatacattgaatggggagcggcaggaatcggtgctttggcgttgtttctttttttcttccggatattgccctatcatctgttccatcgggagcagacacagctctttttgcttgccaccgaaccattggccgggtatctgcggcatccggcggctctggcacgtctgtcaggagatttcctcactcaattcttttattacgaagggggtggcccgaccataatggctgtcgtgctgttgctttggggagtggtggtgtttcgtttgttggctccgtacatgggacgttgggcgtggattcctacggtgttggcggtggcttgggaggcaggaaggcaatgcggattgagttatccgctttccggcacaatcgctttaaccggtatcggaggtgttttgttgttgtgccgtagctgcatgcgacgttcgtggaagtcgggcttaccggtaagcatattggcggtattgtccggctattggctgtttggctgtggcgattggtcgtcacgatggtacaatatgcccgatttagggcgggaatatcttttggcgttggattcggaaatgtatttcggccgttcggaaaaagtacggaaactgttggtggagggtgaataccgctctccgttcactgcctattattataatttgctgaatgcacagcagaaccggcttcccgaccggctgatggatggttatcaaccggcttcgcaagggctgtttctgcctgtggctccccattctacctacctcactatttatgcagccaatgaagtctggtttgcgttgggagatatgacgatggctgaacatgccgccattctgggaatgattttttctccgcaccacaccggggcaagagctgtcaagcgtttggcggaaatcaacctggtgaacggtgatgaggcggcggctatgaaatatcttcgtctcctgcaaaagacaatgtgttaccgtgattgggcagaacgacgtattcccggaaaacagacggccgaagtctgccaatggctggaacggaagcggttgttgttgcctgcaacggatactttgcgttcttctgccgacattccgctttcacttcgtcatctgttgcgtaacaatcctgataatacgttggcatgcgattaccttctctgctttgatttgctgaataaggatattggggctttcgccggagattatcgggagtttgctgcaaagaagtttccttccagattgtatgccgaaggtttacttatctatcttgccgggaaaaaggcttcgttggatgaagtggaaaaatggaatataccgcctcaagtattggatgaatttggcgattatacccgactgtacgaggcgaatggtggtaatggtgcccctttgcaagccaaatacggaaaaacatattggttttatttccactatgctacgatgaaaaaggggaagtgatttatgatgaacatagatatgaaatatatacaagttgttgtggggctgttactgtgctactgcctatatgcttgcagtccccgtccggagtctgtacagcctgcagaccggttattggtgctctatccggaatatcaggatgtaaccattccctacaatgtggctcctttgaatttccttgtgcggaatgaaggggtggatgcggtatgcgtgagtgtaaagggagcatcggacagcttggagataaatgcgcgcgggaacaaggcgatattccccttgaaagcttggcgtgcattgcttgaagcggagaaggaacatactttggaagtaactgttactgcccgtaccgacggccgctggctgcgctatccttcctttgcatggcaggtagtggcggacaagcttgacgcctatgtcagttaccgtctgatagagcccggttatgaggtatggaataccttgcagatacgtgaacgttgtattgagaatttcgaagagcgtattttggcggataacagtcagacagacggcaagtgcatgaactgtcatgtgcacggaggaaatagtggcaacctttcgatgttccatcttcggggtgagggaggggggactgtcctgaaccgtgacggcaagctccgtaagcttgccttgaagaatgaacagatgatatctgcggctgtctacggggatttccatcctgacgggcggtatggtgtgttctcgtctaatgtgattattcccatgttccatacggaaagtaaccgccgtctggaagtttacgataccgtctccgatttggctgtcgccgattttgacggaaaccggatgattctatctccgcttacggcggattccaccgtattggaaacttttcccacattctctgccgatgggaaatggatatattactgctcagctccgactgtgccattgccggacagcgtacagcaattacgctattcgctttgccgcattgcgttcgatgccaatcacggcgcatggggtgaccgcgtggataccctttggaatgcccggctggagaaaggctccgtgtgtcatccgaaagcctcaccggacggacgctacctgctttataccgttgctgattatggaacattccccatttggcaccgggagacggaattgcagctgatggatttgcagacgggcgccatcgactccctgccaatggtcaactccagccgttcggacacttatcacagttggtcgtcaggcagccgttggtttgcctttgccagcaagcggggtgacgggcagtacgggcgggtttattttgcctatctggatgctgaagggaaggcgcataagccttttgtgctaccccagtcggaccctgaaaaagacgatttgacattgaaatcctacaatattcccgatttgtcggctactcccgttccttttgatgcttcttccatcaagcggataaaccggcaactgaaggctgaggaattcaaatgacaagacatacagagagtaccaaattgtaaataataaattgtaaatagtaaatgttcttatttctgaaaaagacttggaagatagggttgtcgatactttttggcgtagcggtgcttctcttttggggaagcgtatatccggcccatatttcctatcaggagcagttccagcttttcttgttcgatgccgactactggtgggaacggatagtggttcccggtgggttggccgattatatcgctgagtatctgacgcagttctattatcacgtgtgggcgggagcttgtattctggcttttttgtacgtgttgttgcaacggttggtttggaaactggcgaaggagcagggtgcggctgatgtgtattatccgctgagttttctgcccatcattgtcttgtggcatttcatgggtgatgaaaatgcgatgctgtcattggtggtggctctgctgttagcattgtctgcatcctgctggtatgcggatttgaaagggaagtggcagcgtgtggcatacattctgatagtccttccgctgctttactggacagcgggtgcggcacacttcatctttatgggctgggtgattgtacgcgagttccggttgaatcttaaaggtaagaatttctggggtggtgtcggagtgttctggggtgtaggattgtggggtatcggttgtccgctattggcaagcatgtgggtacaattccccatttaccgtctgatgggtggtataggatattaccgtttcccggcagtgattccctggatagagatagggcttgccgtattactggttgttctccccttcctgctgtccgctttgcccgctttgaagaagaagccggtattttatggagttctgcaagtggtggcggtaacattgttcggctattactacgtggcggccggttgcgatatggataaagaggaagcgatggagtatgaccagctggtacgtaataaacaatggcaggagattatagaaaaggcagaagagaagtcaccggtttcacctttcggcgtgacctgcctgaatcttgctttgggaaagacgggacagatgggcgaccgtatgttcgagttttaccagaacgggacggaagggctgctgccggagtttcagcgtgattttacttctccgttgcccaccagtgaggcatactatcatttgggtatggtcaatacggcacagcgtttcacttttgaggcgatggaggccatacctaacttcaacaagagtggccgttgcttcaagcgtctggcagagacgaacctgataaacgggcaatacgaagtggcagccaagtacctgcgtttgttgaggaagacaatcttctacagggattgggcagaggatgccatgacctatctgtataatgaggaaaaaatcaatgcccacaaggagtggggttggttgaggcagatacgctatacggaagacttcttgttcagcagccaggaaacggacatcatgctggggctgctttaccagcacaaccaccggaaccggatggcatttgagtatatgctggcctatgtcctgcagcaacgtgatttggaacgtttcatgaagtactatccgctgggcaagcatgccggctacgaccatattccccgcagctatcaagaggcgttgatatatgtatggacacagacgcacaagaacttccagggtatgccgtggagtatttcgccccaagtggtgcgggatgtaacggaatttgcgcggatatatacctcgcagcagaatgcccggcagatgttggaggcgcgtttcggcagtacatactggaattatttgctactaagaaagtaaaatgaaaaagatgaagaatatagctgtttgcataatggctgcatggtggtttgccgcttgcggcaatccggtgacttccccggaaagggtggatgaatggccggatatctatcccgactatatcggtgtgactattcctgcaaccattgctcctatgaatttcaattgtattggtggagcgtacgaacgtgtggatgtgaccgtgaccggaggaaagtccggagagatgcacgtaaatgataaaatagtatcatttccgcaagatgcatggcaagagcttttggaggagaacaagggtgatagccttctgtttacggtatgtatccggaaagacggcgagtggaaacagtaccgctcttttcccatgtatgtcagtccgtatcctatagattatggggtggtataccgcaagctggctcccggatatgaagtttatagcaagatgggcatttatgagcgtgaccttgcttcgttcgaggagcgtcccttgctggagaataccatggtgccgggcatgtgcctgaattgtcatgctttcaacaaaacaaatccggaccatctgagcctgcatatccgtggaaagaacggagggaccttgatgcagatagacgggaagcgcgaaatgctggatacgaaaacggattccactctctctgcgggggtgtacccttattggcatccaaacggcaaatatattgcctattctgtcaacaatacgcgccagtctttccatgcggtgaaggatgagcgtgtggaagtgctcgacttggaatcggatgtactggtctatcatcccgagacacatgaattactgctctctcccttgcttcagaagaaggaagtcttcgaaacctttccagtattttcaccggacggacgcaaactgtatttctgtactgcggaggccaagccgataccggcggaatataaggaaatacgttatagcttgtgtagtatagatttcaatccggaagacgggacatttggcgaaaagatagatacgctggtcaatgcggcagctatgaagaaaagcatctccttcccgaggccctcgtacgatggcgagtatatcatgtttactttgtcggattacgggaatttctcaatttggcataaagaagccgatttatggctgttggatttgaaggatggcggtatgcgtcccataaaggaggtgaacagcgatgatacggaaagtttccataactggagcagtaactcccgatggtttgtgttcagtagccgcaggggagatgggctttatacccgtctgtatctggcaagtatggatgagaatggggtggtgggcaagcctttcctgcttcctcaggaaaatccttgggagtattacgaccgtctggtctactcgtacaatgttcccgattttacaagcgaaccggtgaagctggaacgccggaaagtggaacggggaattgtctcgcggaagcgcgttccggtgaaagttagatgatacgttttttatattctgctttttaatacagtaaagggataaaattgtatcattttctcttggtgcaatccgctatctttgtgccaggaattagtgttaccaataacaataccagattgaaaaacatggatatgagaaaagtaaaatttgctatgatgattctggcggcaagtctgttgaccgcctgcggttcttccaagaaagaacagagtgtgaatgaagagacggctgctgcgcgtacgcaggaaacggagaacttactggctaacttgaaaaaaatcccttccaaaggtatcatgctcggccatcatgacgatacggtatatggtatcggctgggaaggtgaggaaggccgttcggatgtgaaaagcgtgtgtggcgactatccggctgttatcagctttgatttgggagagctggaacttgggaatgccgccaatctggataaggttcccttcgataaaatcaggaaagagataatcaatcagtatcagcggggcggcatggtttcgctcagttggcatgcgcgcaatcccaagacgggcggtgatgcctgggatgtatcggatacgacggtggtgaagtccatcttgcctggtggcgagaatcaccagaaatttgccggctggttgggaggagtggccgatttccttcattcgttgaagacggcggacggcgtgaagatacccgtacttttccgtccctggcacgaacacagcggcagctggttctggtggggcgaaaaactgtgtacccctgaagagtataaggcattgtggcacatgacagtggatactctgcaggccaaaggagtggacaatgcactttatgcttactctccgggcacggaacccaaggacacgacggaatatttgaagaagtatccgggcgatgagttgatagacgttatcggtttcgatacctatcagttcgatcgggatgcctatcttgccgggatggatagggcactttccattatcgacagtgtagggaaagcacacaataaggtgattgctgtgaccgaaaccggttacgaaggaattcccgatgccaaatggtggactggtactctgctgcctgcgttggagaaatatccgcttgcctatgtgctggtgtggcgcaatgcccgtgaaaaggtgacccattactatgccccctatccgggacagacatctgcggaggattttgtggagttctataacaatcccaagacgctgtttgcagctgatgtaaatctgtatcaataaacaaacaatcaatataacagacatggaagcttttaaagaaaaggtagagaggctctttcagagacacgaagagttgattacgagaaagaatgtggccgtggaagacggcaatggcatattcacccgctataaatatccggtagtgacggctgctcatacacctgtattctggcggtatgatttggatgagaagtccaacccgtacctgatggaacgtatcggtatgaatgcgaccatgaattcgggggccattaagtggaatggcaagtatctgatggtggtacgtgtagagggcgctgaccgtaagtcgttctttgccgtagccgagagtcccaacggcattgataatttccggttctgggattaccccatcagcatgcccgaagacacgattccggcaacgaatgtatacgacatgcgactcacggctcatgaggacggctggatttacggtatcttctgcgccgaacgccacgacgacaatgcgcctgccggtgatttgtcctcggctacggctacagctgccattgcccgcaccaaggatttaaagaactgggaacgcctgcccgacctgaagaccaagagccagcaacgcaacgtagtgctgcacccggagtttgtagatggcaaatatgccctctatacccgtccgcaggatggctttattgatgccggcagcggtggtggtatcggctgggcgctggtggacgacataacccatgccgaggtgaaggaagagaagattatcgaccagcgctactatcacaccatcaaggaggtgaagaatggtgaaggtccgcatcccatcaagactccgaaaggatggttgcatctggctcatggtgtccgcggttgtgccgccggattgcgttatgtgctttatatgtacatgacttccctggaagacccgacgaaactgattgccactcccggtggggcctttatggtacccgagggtgaggagcgtataggtgacgtaagcaatgtacttttcaccaacggctggattgccgacgaagacggaacagtattcatctactacgcttcttccgacacgcggatgcatgtggctacctctaccattgataagctggtggactattgcatgaatacgcctgctgacggcttgtcttcatcagcttcggtagaaacgttgaagaagctgatagacaagaatttgcagataatgaaataataaaaatacaacatactatggcaacactaaaagagaaaatcggttatggttttggggatatgtcttcctctatgttctggaaaatattctcctattacttaccgttcttctattcgaatatttttggtttgagcttggctgatgcaggattgctgatgctggtgacacgtatttgggatgcagtgtccgatccgatgatgggagtcattgcagaccgtactcatacgcgttggggtaaataccgtccttatttgttgtggattgcagctccttttgccattgccgggattttactttttacaacgcccgacatggggacaacgggtaagctggtatgggcttatgtcacttacatcctgatgatgacggtatatacggcaatcaatgtaccatacggggctatgttgggagtaatgactgatgattcgaacacaaaaacggttttctcttcttaccgtatgttttttgcatacggaggtagttttatcgctttgggagcatgggagccattgtgtaattggtttaaatcaatggactatagcaatgcttccagttggcaatatgccatggtatgcattgccacgctctgctttttgggttttctgttttgctttagcatgacgcgcgagcatgtcaagagtgtggcgtccgaatccatcggtaaggatgtgaagtcactggtgcgcaattcgccttggtggatattgaatggtgcggcgttgttgtcgaatttcttcaatacggtacgcggagctactgccgcctacttcttcaaggactatatcagtgccaatgcattcctcgatttcggggtgttcaatctggtattgtatgccggcttgttcctgatggtgggtgaagtgtgtaatatgattggtgtggcgctggctgtgcctctgtccatgaagtttggaaagaagtccacttatatcatttcgctcgtgtgcctggtagtgctcagcgtgctcttcttctttgtgccgaatgacgggctgggatggtggctgatgatgattttccaggtgcttatctccatctgcaccggtatcgtatctccgttgatttggagcatgtatgcggatgtggcggactatgccgagcaaaaggatggcacatcctctacggggctgatattctcttccggttctatggcgcagaagtttggcggtgcatttgcaggctgggcagtaatggcactgttggcattcttcggttacaataccgcagagaatgccgtgcagactcccgaggcgctggatggcttgaagtatctgatgagctttattcctgctgcgatagccgcactttccatcgttgtcgtattcatctatccattgaataagacgcgtatggcagccatcaatgcagacctgaaagagcgccgtgagaaccttcagcagaataacttataactcataactcaaaaacttgtggatatcaagaagatgaaacaggagatggaggaggagttggtctccaatatcctccccttctggataaacagaatgacggatgaagtgaacggcggcttctacggccgtatcacgggtcgagaggaggtgaagcccgaagctgaaaagggggccatcctgaacgcccgcatcttgtggaccttttcggctgcataccgcttgctgaggaggccggagtatctggaaacggctacgcgtgccaaacgcactcttatcgaccgtttctacgacaatgaatttggcggagtttactggtctctcgactataaaggcaatccgctcgataccaagaagcagatttacgctttgggtttcgccatctacgggctgagtgaatatgctcgtgccacgggcgatgatgaagcgctggcatatgccatccgtttgttcgagactatcgaagagcatagcttcgaccccgtgaagaacggttattgtgaagccttgacccgcgaatggggagaaatagccgacatgcgcctcagcgccaaggatgagaacgagcgcaagacgatgaatacccatctgcatattctggaaccttataccaatcttttccgcatgtggaaggatacccgtctggagaggcaactgcgcaatttgataggccttttcacggaacggattctgaatatcaagaccggtcatctggaattgttcttcaatgatgattgggttagtaaataccgcattgtctcctatgggcacgatatcgaagcctcctggttgatacacgaggctgcccttgttctgggcgataaggacctcctggagaaagtggaaccacttgtagaatacatcgctgccgctgccgatgaaggattgacgcccgacggcagcatgatatacgagacttttctggataaaggaaagaccgataccgaccgccactggtgggtgcaggccgagaacgtagtgggacatgccaacctctaccagcactttgatgacgaagtggccatgcagaaggctctccgatgttgggacttcatcaagcagcatctggtagactacaagtacggagaatggcattggagcgtgcgtgctgacggcacggtgaacaccgatgatgacaaggcgggattctggaaatgtccgtatcacaacggacgtatgtgcatggaaattattgaacgtttttcataggttttctatcataagaagatgaatagattgatggttttggggattcttgtctggatggggattgcgctgcacgcgcaatctctttatccggacttcagcaagctgaacttcgggtgcgacggaaacagcattaccgcaggcgaacaatggtctaagactgtagtggataaactcggattcgctacacatcacaacgtggcggtcggttctgccacatgggcatgccatcccgatactcaggattatggcagcgaagcttttgccggcatctctggcggttggcaggttacggaggataggcatgagttacagatgcggcacaacaacgtgtcaaaggtgcatatccagaagttcatagccgaagtggaaagtggcgcttaccctgcgcccgatgtctttgtgttctctatgggaacgaatgaccgtaacttgggtagtgccgaagaggcccttaaagggaagacgctcgatgaagtagatgtcaacaccatggcgggcggtgcccgttggtccattcagaccattctggagcattatccccaatgccgcgtattcgtgtgcacgccgattcagaccggcaaccccgaacacaatgcactgaatctgcagaagattgccatcttgcgtgagttgtgccgggcgctttccgtgcagctgatagactgttactccaattgtggtatcaccgaaaagtttgagcagccttccggtagcgggcgctatctgcgcgacgggttgcatcccgacaaaccggggcaggagctgatgggccgttacatcgcgaaggagatacggaaccatttcttttagttccgttctgcatattccggttggaataacttatcatttagggcttgtaaagccctttttttgtctgtattcttaatgacgaatgccacgtcattattgctgctgccatatgaaatcatccgtagggggatgtcctttagcgcctccataatctttgcctcaaacccggcatattcccattgcatgttgcccaccacggagacgatggtcatgcggtcttctaccaatacatgggcatattggcgtagttcggagatgatgttcgataaacgagtgcagtcgtctatagccacagatacgtccagattggaggataccagcaggcagaggggggtacggtacttggcaaaaatgtcgaaaatcttgctgatgaacagatagggacacagattatggttcgattcgaactttatgtatatgatgtggtccttggcggctatggccttgatgatattgtcgtcctgcaggttggaaattagcgtgccttctgccgacggttccatagagttaagcaaccggacgggaatattccttaggcgtgccggggcgatacagaagggatgcagtatcttggcaccatagaaggccagttgttcggcttcgttgaagctgaggcgtttcacggggcgggtacctgacacctcgcgcggatcattgttgtgcatgccatctatgtccgtccatatttgtatctcgtctgcttggagggcggtgccaatgagggaagcagtgtaatcactgccgccgcgtttcaggttatctgtttcgttataggcattcttgcagatgaaaccctgagtgatgaagagattgatgccgggatggcaggcaagctgttctcggagtttttgttctatatattccaagtcgggttcgttgtcggggccggtacgcatgaagtcgaatgcacaaagcagtgcattgggaattttcagctcgcgcaggtagaaatgcatcagagcggtactgataagttcgccttgtgccagcacctccttctcttcgacggaggtgaaagagttcttggtaaatttccatagttgctggaagcggtcgaggatataatctattgcttcccgtttcagtttctcgtcggtcagcaacccattggcaaattcgatgaactggaattccagccgggtgatgcggtcgtgggcttgttctatttcacggttgaacaagttggcggcaatctcctccagatggttggtggtgcctgcggtggcagacagtaccacaatcttgggtgttgcatctttaatgagtgttgctacatgtttcattctctctacggtgccgacggaagttccgccgaatttacaaactttcatttcttgtttcttttttaacagtttcataattgcattcatccggatgttcttccttccggcttttcatttcaggtggcctctttccaaaatggaagggggaggcatgaggggctgtcactgggactaggcctgcataatgccgctgtggcattgttgtggtgggatattcatatcccggttggtggcaggctcttgccccttcacctataaaagttcaaaagatatgccgttggtatttgggaaaagcttatatttgcacaccctgttttttaccgttatcagtttaaaaacttatcgaatagatatgagtaagattctaatcattgatgatgaggtacaaatccgtacccttctgacacggatgatggagttggagggatatgacgtctgtcaggctggtgattgcagggctgccctgaagcaactggaactccaaaatcccgatgtagttttgtgtgatgtgtttctgcccgatggaaatggggtagacctggtgttggctatcaagaaggcggcacccaatgtggaagttattctgctgacagcgcacggcaatattcccgatggggtgcaggccatcaagaacggtgctttcgactacatcaccaagggagacgataataacaagattattcctctgataagccgtgctgtagagaaagcgcgtatgaatgtgcggttggaaaaactggagaagaaggtgggacagacgtactcttttgattctatcctgggagaatccaaagtcctgaaggatgctgtttcattagctcagaaggtgtcagggactgatgttcctgtactgttgactggagaaacgggcacgggtaaggaggtatttgcccaggccatccattacagtagtaagcgtgcacggcagaattttgtagcggttaactgttcttcgttcagcaaggagttgctggaaagtgaaatgttcggtcataaagccggttcgtttaccggcgcattgaaggataagaagggactgttcgaggaagcgaataatgggactatttttttggatgaaatcggtgagatggcgtttgaactgcaagccaagttgctgcgtattcttgaaaccggtgagtatattaagataggtgatacgaaacctacccgtgtcaatgtccgcatcattgccgctacgaaccgcaacttgtcccaggagattgttgccggacgtttccgcgaggatttgttttatagattaagcgtatttcagatacatctgccgccattgcgcgaacgtgcaggtgatatccggctgttggcgaaggcttttataaagagttttgcggaacagctggcgcgtccggtggttgaaatagctcccgcatttcttgaagcattggactcccaaccgtggaagggaaatattcgtgaattacgtaacgtgatagaacgcagtatgattgtttgcgagagcggatatctggacattgctgatttgccgtttgatattcagaatgcccattatgaacactccaatgattcaagtcccggcagttttgaactttcagctatggaacgccggcacattgcccgtgtactggagtatacaaaggggaataagacagaagcagcccggttattgaaaataggtttgacgacgttgtatcggaagattgaggaatacaagatctcagatctataatagggggctcagtatacgactgaggtaccttcgatataggaccgtggcaagattattcttgaaacaggcttagaagcagaaagtgcctatgggctaaaacatatcaaaacaggttgcaccttttcattttgaaagggtgcaacctgtttctttttatacttgtttagtatgtattctgttgataattaatggtgtatggtatatgcgctctttttggcacatatttggcacattcctggcagacaaaaatatgtagtaacattttaaaaggtaaaaacatgggaataacagtatcatttattttttgcctattgagcggtttgttcgccttttggcttttctggaaatgcgtagattggtttgagaagatttaaaagagagaattatgtacacagctttatttgtattaggtattgtaatgttcgggtatctgacttatgtgctgataagacccgaaaagttttaatgaatggagagtggagaaatgaacactgaaattttaggtgtagccttgcagattgttctgctgattgtgatatcctatcctctgggaaagtatattgccaaggtttacaaaggcgaaaagacatggtcggatttcatgaagccggtcgagagattgatttataaagtggccggagtcaatccggaggaagagatgaactggaaacagttcttgaaagccctgctgattctgaatgccttttggtttgtatggggcatggtgctactctgtacacagcagtggttgccgttaaatccggatggaaacgctaaccagacaccggatctggcattcaatacatgtatcagttttatggtgaactgtaatttgcagcattattccggtgaaagcggactgacatattttacacagttgttcgtcattatgttgttccaattcattaccgccgctaccggtatggcagctatggcaggtatcatgaagggtatggctgctaaatcgacgaagactatcggtaacttctggaagttcttggttttgagctgtacacgtgtattattaccgctttcgttgattgtgggcttcatcctcattctacaaggtactccgatgggatttgatggtaagctggaagttcagacgatggaaggacaaacccagttggtttcacaaggtcctacggcagcgattgttcctatcaagcaattgggtacgaacggtggcggttactttggatgtaactcttcacatccgttggaaaatcctacttacttgacagatattgcagaatgttggtctatcctaattataccaatgtctatggtgattgcactcggcttttacatcaaacgtaagaagatggcttactctatctatagcgtaatgctttttgcttttcttgtcggtgtttgcatcaatgtttcgcaggagatgggaggtaatccgcgcattgatgagatgggaattgcccaagacaatggagcaatggaaggtaaagaagtccgtttagggtctgctgctactgctctttggagtattgtgactacagttacttccaatggctctgtgaatggtatgcatgattcaacgatgcctctttccggtatgatggaaatgctgaacatgcagattaatacgtggtttggaggtgtgggtgtaggtttcatgaactattatacattcatcattatcgccgtattcatcagtggactgatggtgggacgtactccggaatttctcggtaagaaggtagaggcgcgtgaaatgaagattgctaccattgtggcactgcttcatccgcttatcatcttgggcggtgtggcactttcttgctttttgttcgctcattatcctgaatttgtggcaggtgaaggcggctggttgaataatcccagtttccacggactgagtgagcagctttatgaatatacttcggctgcggccaataatggttctggcttcgaaggattgggcgacaatacttacttctggaactatactaccggctggacgctgattttaggacgtttcctgcctatcgtaggtcaggtagccattgctggtctgttggccggaaagaaatatgttccggagagtgccggtacgctgaagacagatacagtaactttcggtgtgatgacttttgccgttatctttattgtggctgccttgtcattcttcccggcacatgcattgagtacgattgctgaacatttcagtttgtaatagtagtttgtaaaaagtaatttcataggtatgaaagataataaatcagcttctctgtttcagaaggagcaagtaatggaaagtttgaagcaatcattcgtgaagctaaatccacgggtgatgataaagaatccgattatgtttacggtggaagtcgtaacggttgtcatgctgattgtctgtttcctttcattgggtacttcggaatatggagcattcggatataatttattggtattcatcatcttgtttgtgacgttactgtttgctaattttgctgaagccatcgctgaagctcgtggtaaggcccaagctgacagtttgcgtaaaacccgtgaagagactcctgctaaagtgttggttgacggtaaaatccataccgttagcagttcacgtttgaagaaaggtgactattttatttgtgaagcaggagatacgattcctgccgacggtgagattgtggaaggtttggcctccattgacgaaagtgccattaccggtgaatctgctccggttatccgtgaggccggtggtgacaagagttccgtaactggtggtacaaaagttctttctgataaaatcaaggtattggtgacgcagcaaccgggtgagagctttcttgacaagatgattgctttggtagaaggcgctactcgccagaagactccgaacgaaatagcattgactattcttctggctggtttcactttggtattcgttattgtatgtgtaacgttgattcctatggctgattatacgaatattgaccatccgggaacttatatctccattgcagccatcatatctttgtttgtctgcttgataccgactactatcggcggactgctttctgccatcggcattgctgggatggaccgtgctttgcgcgctaatgtaattacaaaatccggtaaggcggtagaaacagccggtgacattgataccttgttgctagacaagactggcaccattacaatcggtaaccgtaaagctactaagtttcattcggcttcgggtgttgacgagaatttgttcgtagaggcttgcttgttgtcctcactttctgacgagactccggagggtaagtctatcattgaactgggacgtgaaaacggtcatcgtatgcgtgatttgaatactaccggtgctcatatgattaagtttacagccgaaacaaaatgttcgggtgtggatttgcaggatggtactcagatacgtaaaggcgcattcgacgctattcgcaagattgtggaaaatgccggaaacaagttcccgaaagagattgaagaggtgattgctgtaattaccagcaacggtggaactccgctggtggtatgtgtcaatcagaaagttactggggtaattgagttgcaggatattatcaaaccgggcattcaggaacgttttgagcgtcttcgcaggatgggtgtgaaaactgtgatggtgaccggtgacaaccctttgacagccaaatatattgcagagaaagctggagtagatgatttcattgctgaagccaagccggaagacaagatggaatatatcaaaaaagaacagcaggccggtaagctggtggctatgatgggtgacggtacaaacgacgctcccgcccttgcacaagctaatgtgggtgtggcaatgaacagcggtacgcaggcagccaaagaagctggtaacatggtggaccttgacaacgatccgacgaagctgattgaaattgtggagattggcaaacagttgttaatgacgcgcggtacgttgactaccttctccattgcgaacgacgttgccaagtactttgctattatccctgctttgtttatggtagccatccctcagttggctcctctgaacattatgggactgcatagccctgaaacggccattctctcggctgtcatattcaacgctatcattattcctatcttgattccgttggctttgaaaggtgttcagtataagccgatcggtgccagtgcgctacttcgtcgcaatctgttgatttatggtgtgggtggcgtcattgctccgtttgtcggcatcaaactgatagatatgatagttagtctgtttttttaaaacttggataaaatgaaaactctttggaaatcatttaaaataacaattgcattttgcatatttttctctctgttctatatccttgtcttgtggatatttgcacagttcgccggtcccaacaagggaaatgcagaggtggcaacactcaatggtaaagtggtaggtgcagccaatgtaggccagatgtttacgcaagatatttatttctggggacgcccatctgcgggtaattatacagccgatgcttcgggtggtagtaacaagggacctacgaacgatgaatacctggcagaagtggaagcccgtatcgatacttttctggtacatcatccttatctgagccgcaaggatgtgcctgctgaaatggtaaccgccagtggttccggtctagacccacatatcacacctgcttgtgcttatgtacaagtgaagcgtgtggctcaggcacgtggcatgaacgaggctgaagtgaaagccattgtagacaagaacatcagcaaaccctttttgggggtgtttggtacggaaactgtcaatgtgctggaactgaacattgcattagaagaagccgatcagaataaataattttggcagttatataccacccgaccctaagccgggtgggtataacttatgtttataattagaccgctaagatagcgattagagcacagttcagaggagtaagagatagagcttttttcttatatagacttgctaaattatatgcttaaatataaaatacctcagattgttacgttgacccctgactgataccaagcctcacaaattcttgattcagtacttctatctcttgccagatatctgttcccatgagcaaagggcataaaagataagtataaaaagaaagcggggaaaagcattaaaactttccccgcttctttatttcgtacccagacccggggtcgaaccgggatggaagtgaatccactggtgtttgagaccagcgcgtctaccgattccgccatctgggcatgtttgacttctcaaatgcggtgcaaagatacagcttttttctaaacctgcaatacttttcctaaaaaaaggcgaaaaaaacgataaaacctgcttgaatcattccttgtttgtaaaatatgcagtacattagcagaaacttttaaaatcaatagcatggtaaccaataaggataatttctgtgtaattatgggcggaggaatcggcagccgtttctggccattcagccgcaagacacttccaaaacagtttctggatttcttcggtacaggacgttccttgctgcagcaaaccttcgaccgcttcaagcaggtaatccccatggaaaatatacttatcgtaacaaatgacttgtatgccgaccttgtaaaagaacagcttcccgaacttaaacccgaacagattctactggagccgacacgcaggaatacagccccctgcattgcgtgggcttcctatcatatccgcgccttgaatccgaacgccaatatagtggtagctccttcggaccacttaatcctgaaggaaggcgaatttctggcagccatcgaaaaagggctggacttcgtttcccaatcggacaatctgctgacactcggcatcaagcccaaccgtccggaaaccggatatggctatatacaaatagccgaagccgccggtgataatttctacaaggtaaaaaccttcactgaaaagcccgaactggaactggcaaaagtattcgtggaaagtggagaattctattggaactctggtctgttcatgtggaacgtaaataccatcatcaaggcaaacgaagccctgctgcccgagctgacttccaaactggcccccggcaaagatgtgtatggaacagtccaagagaaacaattcattgatgagaacttccctgcttgccccaatgtctccatagacttcggcatcatggaaaaggcagacaatgtatatgtgtcattaggcgatttcggctggtctgatttaggaacctgggggtctttgtatgatttgtctcccaaagatgaagcaggcaatgtagccttaaaatgtaaatccctcatctataatagcaaagacaatatcgtggtgctgcccgacaacaaacttgcagttatcgacggtttggaaggttatctcatagccgagtcggacaatgtattactgatttgcaagaaagatgaagaacataccatccgcaaatatgtgaatgatgcccagataaaactgggagaggaatacatttaaattaaaaattaaaggataggtgccgaaggcaaaaaaatagcgggagctggatgaagtccaactcccgcttccgtttatttaggggaggaaaataaaccgattaaagcactgcacggatagcttctgccacagccttgaattcttcgtccgtcagtttcagtttgggattggagaaaagcatatctttttcgttctgcataggaatcaaatgtatgtgcgcatgaggcacttccagccccaataccgcttctcctacctttctacacggaaaggccttgccgatggcaagtgccactctcttggcgaaaacatgcatcgccgccaaatcctcatcgttcaaatcgaagatataatccacttcctgcttgggaatgaccaatgtatgaccttttaccaacggattgatgtcaaggaacgcaaagaatctgtcatcctccgccaccttgtagcaaggtatttcacctgcgataattctactgaatattgttgccatagctataaattataaaataaggcaagcccgtatgcggacctgccttcctttaaaaggatatgttcactacttccaggttaatcatgccctgcggaactttaatttctgcgatgtcacctactttcttgccaagcagaccttgtgcaatcggagtattgacggaaatctttccttccttcagattggcttcactttcggaaacgatagtataaaccatcttcatgccattcttcacgttcttaagctctaccttattgagaatctgtacagaatcggttttcaacttcgactcatcaataatcttagcgtcggcaatggtcagcttcaagttgttaattttcatctcaagcataccttgagcttccttggcagcgtcatactctgcattttccgacaaatcacctttgtcacgcgcttcggcaatggcagccgatattttgggacgttccaccgtctccaggtgtttcaattcggccatcaatttcttgtagccgtcttctgacatataagccatactttttcctccttaaatgttatgttagtttttaatggtactataaacaaaaaagaattccaacatggtcagcatgctggaaccctctttccgattttcctttgcaaagatagccttttatacaatgcgtgtcaagcataaaaggctgctttgtaacatatttaaacgaaaacttcttatttataacatgttacagcaatgctttcactgccgcctccaggtctttaatgctctctccacgggcactcaactcattgttcttgttgaccaggaacacagaaggcacattcttcacattataagaagccgctatagacgaataaattccattgccgtcgcgcacacaaatccaaggtagattgtcggcagttgttttccaatagtgctcgtctgcatccagagaaacctgatagatttccaatccctgggcggcatacttgtcgtacaagtcgcgcaacatataattatgtgtagcagaaacggcactctgataaacagtgaagtccacaataacagccttgcccttcagttcgctcaacttacgtgtattgcccttcatgtcacgcaggttaatgtcgataatgccggtttcggaaattgcctcttcggggatttccaccaccttctgctgcggagtacgggtattcttcattccctttatcacaatattgtagaggttcttggagcggtcggcatccggataataattgtttaggctggttgccacggctgcaaaacacttaatgtcttccttattgttcagagggtcgaaaatcaaataattattcaacttctggaacaaggcgaaataggcagcagccgtattgggagcggcaaaaatatagctgattttcacttcatccttatagttcttcaataaagaggcaaggctgtcctcaaaaacatcggcacctatcttatgtgcctgcaccgactgcagcaatgcattcacattatcctgaagcttcatctgcttcagcgtcaagtcctttatcttcgagctattcggagaaccttccactgtataggcagtggcgaaatcggtataaggtgcctttaccaaaaccgtttccgtcgaatctaccgagaaattaataaccttgtcgtctacccgcagacggtaaaattccggagacaccggacgtacctgcttgaagtggaaagagccatccccttccagctttacagaatccaaaggaacaataccttccaatgccgaggcttccaaataaagcatcttgccgtcggcaccagacacttcaccctctactttgaatttcggttcggaattacatgcacccaatgctattgcagcaagtgccataaaaaagattttcttcatatcgtatcttcagttttgttttgcaaacgtgcctgcaaatatacttcttttcaagttcagtcaaagcattttccctcgttcttccatatagaaaactgcaaaaaacaactaaatacaaactttttatctcattcccaccattttacatgaataaattatgtatctttgcacgaattttgaaagaaaattagatataaaacattttttatgattaacccaattgttaagacgatcgagcttcctgatggcagaaccatcacgctcgaaacgggaaagctggcaaaacaggcagacggttctgtaatgcttcgtatgggcaacaccatgcttttagctactgtttgtgccgccaaggacgcagttcccggaacagatttcatgccattacaggtagagtacaaagaaaaattctccgcattcggacgtttccccggcggtttcacaaagcgcgaaggacgcgcttctgactacgaaatcctcacttgccgcctcgttgaccgtgctctccgccccttattccctgataatttccatgcagaggtatacgtaaacatcattcttttctcagcagacggcgtagatatgcccgacgctctggccggactcgcagcttctgccgcacttgcagtttcagatatccccttcaacggacctatttccgaagtacgcgtagcacgcatcaacggacaattcgtcatcaaccctaccttcgaacaactagaacaagccgatatggacttgatggtgggcgccacttatgaaaacatcatgatggtggaaggcgaaatggacgaggtttccgagcaggacttgctggaagcgatgaaggccgcacacgaagccattaagattcagtgcaaggcacagatggaactggcagaagaagtaggctctaccgtgaaacgcgaatattgccacgaagtgaacgacgaagaactccgtaaggccgttcacgacgcttgctacgacaaggcttatgccattgccgcttccggaaacaagaacaagcacgaacgcatggatgctttcgatgccatccgcgaagaattcaaggcacagttctccgaagaagaactggaagaaaaggcagccctcatcgaccgttactatcacgatgtggaaaaagaggcgatgcgccgttccattctggacgaaggcaagcgccttgacggacgtaagacgaccgaaatccgtcctatctggtgtgagaccagctacctgcccggccctcacggttccgctatctttacacgtggcgaaacacagtctttgtctactgtgactttaggcaccaagttggacgagaagattatcgacgacgtattggaacacggaaaagaacgtttccttctgcactacaacttccctccgttctctacgggcgaagccaaggcacagcgcggtgtaggccgtcgtgaaatcggccacggccatctggcatggcgtgcattgaagggtcagattcctgcaaactatccgtatgtagtacgcgtggtatccgatatcctcgaatcaaacggttcttcttccatggctaccgtatgtgccggaactctggcattgatggatgcaggtgtgaaaatcaagaaaccggtatcaggtatcgccatgggattgattaagaatgcaggcgaagacaaatatgccgtattgtccgatatcctcggtgatgaggaccacttgggcgacatggacttcaaggtgaccggaacaaaagacggtatcaccgccactcagatggacatcaaagtggacggtctgtcatacgaaatcctcgaaaaggcattgctgcaggctaaagaaggccgcgaatatatcttgggcaaaatcaccgagtgcattgccgagcctcgcgaagacctgaaacctcacgctccgcgtatcgagacaatgaccattcccaaggaattcatcggtgctgtcatcggccctggtggaaagattatccaaggtatgcaggaagaaaccggtgctaccattactattgaagaagtggacaacatcggtagaatcgaaatcgccggtaccaacaagaagagcatcgatgatgctatgcgtatcatcaaagggattgtagctgtccccgaagtaggcgaagtctacaaaggcaaggtacgctccattatgccttacggtgcattcgttgaattcctgccgggtaaggacggcttgctccatatctccgaaatcgactggaaacgtctggaaacagtagaagaagccggtatcaaggaaggtgatgaaattgacgtaaaacttctcgacatcgacccgaagaccggaaaatttaagctgtcacgcaaagtattgcttccgagaccggaaagacaagaaagaccggaaaagaaataagaaatttcttattctttaagtatataaagcctggtggaaccccatcaggctttctttttgtcaatactgccagaaatggctctgaaaaaacaaggcataatgcttgcatattccaaaaagattatgttttttttgctatgtaaagccttatattccataaagaacctcaattaatgtccggtttaaggagcctacatactatgaatcttttctcacgctttttccaggaaaaccaagaaaagtttttggcttttgcttattcttatctcagggataaagcagaagcggaagacgttgtgatggaatccatgattgccttatgggaaaaccgagaccgctgggaagaaaacagtaacctgcatgccctgctgctgaccatcataaagaacaaagccctgcacgtactcgagcacaagcaggtgcgtctgcgagcggaagaaaccatcagcagccacaacctgcgcgaactggacttacgcatctccaccttgaaagcctgcgaaccggaccagatattcaacacggaaatacagcatatcgtaaataagaccttacaggaaatgcccgagcaaagccggaagatattcatgttgagccgataccagaacctggcaaacaagcagattgccgatagtctggacatatcacttaaaaccgtagaggcacacatcaccaaagtgctgcggattctccggctgagactgaaagattatcttgttaccatactcataatattaatatcctaaaaaatgcttctacggaatagggttaccgtccactttccggttatatatacaaaaggtaaaaagagcacgttttagaaaagaaataaattattgacaatgaaccaagagctattatataaatatttcaaaggtattacttccgttgaagaagaaaagatgatactcgactggatagacgcctcggatgaaaaccggaacatcttcctgaaagagcgcatgatatacgacatttctttgttctcggacaagcagggaaacaatgaaaagaaaacggtgcgcatcatgccgatgctccgctgggcggcccgtatagccgccgtcaccattgtcgccattgccggttatttcatcacctccgactttttatataacaaggaggtgcagttgcaaacagtcactgtgcctgccggacaacgggcccaaattaccctcgccgatggaacacgcgtatggctgaactccaagtccaccatgaaatatgccgccaacttcggacgcaacgaacgaaatgtggaattggacggagaggcctactttgaagtagccaaaaacaagaatatcccattctatgtacatacagaaacgaacaaggtaaaagttgtaggaacgagtttcaacgtctgtgcctacagtgggagccatgagttcggaaccacattggtggaaggtatcgtcgatatctatccggccaacagcagccagataatcaccaggttgcagaaagacgaggtatttctcaatgaaaacggaaaatgtagaaaggccgtccttccttcctatgaatatctacgctggaaagagggactatactgttttgacgacgctccattcagcggtatcctcggtagactggagaaatactataatgtaaagataaccgttgccagtcctcaactgctgaactacggcagctttaccggcaagttcagagagcaggacggcatcgaacatatactgcggaccatctcgaaagaccatcctttcaagttccgcatcaacgaagaaaaggattcaattgttatatatgagtaagaaaaaaaagatcggaaagtacccccatactttccgatccgaaacagtcaaaaatcgaccttaatcaatttattaacttaacacagtgacaaagatatgagaaaaattttgttgatgaggcttttttatctaaaaaaattagattttaagcaattattgcaaacctatgaaaatcacattattccttctcctgcttgttatatttcaggtgtacagcgggaactgctactctcagaatgccagggtcagcattcaaaatgcccggctgagggtagggcaagttctcgagcaaattgaatcgcaaacagaatacttatttgtatataacaaacagaacgtcgatgtacgccgtaccgtcgacatcaatgcaagcaaccaaactgtttccgaagtacttgaccaaatgttcaaagggacagacatcaagtatgtgatggaaggcaaaaacatcgttttaaccaaaaacagcaggagtgctgaggataagacagacactctgcaggaaatggctactgtaagaggaaaggtgacggactccaaaggcgaaccgattatcggtgccaacattcttgaaaaagggaccgccaatggtgttatcaccaataccgaaggagaatttagtatgaatatccctccttatgccactattgtcgtatcctacatcagttatgaaccgcaaaccattgccctgaacggtagaaataatctccacatccggatggaagaaaagagcctcgccctggagcaagtagtggtaaccgccatgggtatccagaagaaaatgtcctcattgacctattctacccaacagataagcagcagtgagctgacccgtgccaaagagccgaacatgattaatacactggcaggaaagacggccggagtacaaatcaataaaaccgccaatttaggaggttctgccaaagtcgtcattcgcggtgcacgctctgcatttgccagcggcaacaaccagcccttgtacgtaattgacggtgttcctatgctgaacagctcaacagaatccacctccaccgtaatcggcggtaactacgatggattgaaccgtgatgccggtgacgggatttccaacctgaatccggacgacatagaaagcatcaacatcctgaaaggttcttctgccgccgcgctttatggttcgcaggcagctaatggcgtcattctgatcaccactaaaaagggaaaggccggactgcagcgcgttacattctcctccaacctgaccgtaagtcacgccatcagtacccccgaattccaaaatacatacggccggaacgaagatggcggtacggcaagctggggtacaaaaggcaatgtaacggactatgacaacataggcgaattcttcagcaatggcatcaccactttcaattcgctggccatcactaccggaaatgaaaaggtacaaacttatttctcatacgccaacaccacggctaaaggaattgtggacaataacaaactacagaagaataacctgaacctacacgaaacggccagcctcttcaacaacaagctgaaactggacggcattgcaacactaatgacccaaaccgtcaagaactcccctgctaccggcggctattatctgaatccgctggtcagcttgtacagtttcccacgtggcgtagacatgagcacttacagagaaaactttgaaacgtggaatgccgaccgcaatatgatgacacaaaactggattgaaaagaatggagatggtaccgtcagtgaatggggacagaatccctactggctgaaaaaccgcgtgctcagtggctacaagcgttatcgcgctgtggcatcggccagagccaatctgcacattacggactacttcagcctgcaggtacggggtaatgtggattatatcagtgataaattcgacaataagatgtatgccactacagctcccaacatcgccggcaaatacgaggacaaggaaaacggacgttacatctggtcggacagccaggaaatccaagtctacggtgacgcaatggtcttgttcaacaaggaatttgatgacttttccctcaatacggcactgggagccagcatcaacatgagtaaagtcaattcactgacgatagactcaaggcttgcttccctctacaaaccgaatgtatttaccgttcccaatgtagtgatggactccaaagcagccgtaaatcagagcatcgacagcaaacgcacgctccaatcagtatttgccaccatgcagtggggctggaaaggactactatacttggacattaccgcacgtaacgactggtcatccacattagcccacacagacagcaagaataccggattcttctatccctccataggagctacctggattcttaacaaaacctgctccctgcccaaatggataagttttgcaaaagtgcgcgcttcatgggcggaagtcggtaatgacctcccgataggaatcaccaatccggtagacatcatcatggtaggcggcagtatcaatgtaaataccgtagaacagcgcggtgacctaaaaccggaaatcagcagctccatcgaattcggtacagaatggcgcttcttccatcaccgcttcgggatagacttcacttggtatcagaccaataccaagaaccagttgttgagaatggacaatcctacgggctccacctataaataccggtatgtcaatgccggaaaaatacgtaaccagggttttgagctgacggtagacgccactccgctactatacagaaacttttcgtggaagagtctcatcaacatgtccgccaacaagaacaaagtagtgaccctgcatcctgactatccggaattttcctactacgaagaaggtttcaacgcaggctatcagatgcgtgtcaaagaaggaggcagcctgggggatatttatggaaatgctttccgccgtaacgaggatggcagcatcatggttgatgaaaccagcaaaaggcctttaggaaataccggaaacaaggatttgcttgggaatgccaatcctgacttcaccatgggatgtagcaacacacttacctacaagaacctggagctctatttcctgatagatttccgctttggcggcgaagtcatgtcactgacacagtctgagttggatgccaacggcgtgaccaaagtcaccgaagatgcccgcacccggggatatgtagaataccagggacagaagttcaacgacccgagagcattttacagcgcagtaggcggcagaaatgccatctccgaatattatatgtacgacgcaacctgcatcagactccgtgaagtatcactgagctattctttcccgaaaacgatactggaaaacagtagattcataaagggaatcgacgtatcattggcagcgcgcaacttgtgtttcttaaagaaggaagcaccgttcgaccccgatgcagtaatgtccgtaggcaacaacaatcaaggagtagacgtgtttggcatgcctactacccggaatatcggctttaacctaagattaaccttttaaaatgaataccttatgaaaaacaagtgcatcatattccttttctgccatagcatattgctgcttgcagcttgcaccggcggttttgagaacgacaacgaaatcaagggaggtttctcggacgacaaaaaggaaatagatttccagaacctgactgctccattcgaacccatacagtcgggcatctacttcaatataggttctgttggcttaaattgggtatggcagatgacacaatccctgaaccatgacatgttctccggctacttcatggaccctattcctaaattcatgaaatccaacgcctgctacaacctgaactcaggctggaccaatgccgcatggcaatgtacttacggatatgtctacacggaggtgcagaaggcagaaaagaacttttatggcaatgacaacttgaaaggctacctcggcattaccgaaattttgaaagtggaactgatgcaccgcattgccgatacatacggtccgctggtctaccatcaactgggtgagacaccccgggtttacggacagcaagaagcctatacacgcttctttgcagacctggacgaagggcagcaattgataagggaatacctggacgagggcggtgacaacaacaaattcaaagagtatgatatgctgaccaacggcaagaccttgaaggagtggttaaagtttgccaactcactacgtttgcgccttgccatgcgcatctccaatgtagatgcaacacttgccaaagaccaagcaaccaaagcactgaatgacaatcaaggtgtactggaaggtgcaagggaaaccatcgctgtaatgggcaagaactatatcaatcctttgtgtgccgttgccggttggggtgaagtctacatgaatgcctcgatggaatccattgtcaacggttatgaggacccgcgtggcaagaaatggtataacaccgcccttctcgaaggttatcaaaaacagttgttaggcattcccatcggcttacccatgaaagacggtgacgccaacatttacagtttttgctcttccctcaacacaagtaccatcggcgaaaagaccggagccgtattgatgagtgcggcggaagtctggctgctcagggccgaagcagccctccgcggctataccaaagagaatccccgcacatgctatgaatacggggtaagtacttcatttacacagtgggactgtgctggtgcctccgaatatctggaaagcgacaaaacccctgccgattataaagatgtagtctcgggcggtaaggtaggcaaggacatgaaagccttgattaccatatcccccaaatgggaagaagatgcagacatagagacgaaactcgaaaagattattacccagaagtggctggcatgctggcccgaaagttatgaggcatgggctgagcaacgccgtaccggataccccaaacttttcaaggtccaaaacaacaccggaaaagtgattgatacggatatcatgatccgccgccttccgttctcgacggacgccgccactgccgacccggcacaatacgccaccctcacggaaaaactgggtggcgcagataacggcgccacccgcctttggtgggatacggggaaaaactctttctagaacagactccacgcaaccgtaagccctgccatcacaatggctaccatgctcatcagcttgattaggatattcaagctcggaccggatgtgtccttgaacgggtctcctacggtgtcacccacgactgtagccttgtggacttcactgcctttgccgccaaagttgccttcttccacatactttttggcattatcccatgcaccaccggcatttgccatgaagatggcaagcacgaaaccactgctcaatccgccaatcagcaggccgagcacaccgggaacaccgaaaataagtcccgtcgcaatcggagcaatgatagctatcagtgacggaatcaccatctcgcgttgcgcccctttcgtcgagattgccacacaacgctcataatcaggctccgtttctcccgtaaggattcccttgatttcgcggaactggcggcgcacttcgtctaccatatgggccgctgcacgccctaccgcattcatcgtcaatccacagaaaagaaatgccatcatcgagcccagaaacataccggaaagaactttcggattcatcagcgtcacatcgtagtgatgcataaagtcgaagaaagtggcatcttgaagagccacggcatcgccatgaggaagcgacagttcggtagtcccgaggcgggtcagcccgatacggatttcctcgacataagaggccagcaaagccaatcccgtcaaagcggcggaaccgatggcaaagcctttgcccgtagcggctgtagtattgcccaaggagtcaagcgcatcggtacgcttacgcacctcttcacccagaccggacatttccgcattgccacccgcgttgtcagctatcggtccgtaagcatctgtagcaagcgtgatgcccaatgtagaaagcatacctactgcggcaatgccaataccatagagccccagacccacattagagaagtcgaagcccgaagcaaagagataagaagcaatgatacctatcaccacggcaatcaccggaatagccgtagaaagcattcccaagcctataccggaaattatgactgtcgccggaccggtctttccgctttcactcagcttttgggtaggacggtaggattgggaagtatagtactccgtagaccgcccgatgatgatacctactatcaaacccactatcacggagcaggaaatccacagccagttgtccaacttcagcaaccacaggataaagaaagtggcgacaactatcaaaatagagctgagattagtaccgaaagccagtgagttcagcaagtccttcatcttcgcattctctttggtacgcacggagaagataccgataatggaaagcaatattccgacggctgcaatcagcatcggaacgattacggccttgaactgcatcagcgtatcacccgagtggataaaagccgcagcaccgagggcagccgtagcaaggatagaaccgcaataactttcgtacaaatcagcccccatacctgccacgtcgcctacattgtcgcctacattatccgcaatcgtggcaggattacgcgggtcgtcttcggggataccggcttccacctttcccacaaggtcggcacctacatcggcagcttttgtatagataccgccacctacgcgtgcaaacaatgcctgcgtggaagcgcccataccgaaagtcagcatggtagtggtaatgatgcagagtttatgggtgggagtcattacatcttccggaattacagcattcagcaacagataccagaaagatatatcaagcaagccaaggccaaccactaccagtcccatcaccgcaccgctacggaaagccacgcgtagtccggcattcagcgatgtgcgtgccgcattggcagtgcgagccgatgcgtaggtggccgtcttcatacccaaaaagccggaaagtccggaaaagaatcctccggtaaggaaagcaatcggcacccaggagttctgcactccgaaaccgtatgccataatggagaaaaggataaccagccccagaaatacccagcccacaatcttgtattgttggcgaaggtaagacatagcacctttgcgcacagcagcggcaatcttaatcatctgaggcgtaccctcactctctttcatcatctgacgatggaaataccaggcaaaacaaagtgccataatagaagcggctggaaccagccagaataggatttggtccatagcatttattcgtattaaaaggttgaacgaaagcctaaaaatattgatttgaaacgaaataagcaaatgaaaaagaaaagaaatccaagcaagcatgtatttatactggcgaataaaacaacaagcagtacccttttttacctattttttgtatttaatgagaagaacagagcacatatagatatatattacaacttttatagtacctttgcaacaagtaaacaagctaaaaacaaaggcattatgaaaccaatctattctaacctgacatgcaagatgctggctttgacattatgcagcattatgctggcattcctatccataggatgcgaacatgacgtctacaatcccgataatggaaaagacgatgagaagactcccaactcttttgatttttctacgacatcttccatccaagtaaacgtaaagtatgatgtccccgaaggctataaagtactttttgaaatctatcttgaagacccgttcacgattgacaaagatggccagattataaaacgcacagacctggaaccggtcatcagacgcatgacagacggtaacggtgcatatagcggcaaggaaatcatcaattcggaccatggggacgaagcatatatctatacttcttatataggggtccccaccctcttcaaaacagttattgcaggagatgccattactgccgacatcaaatgggattccaccgatgataatccgcaaacacgggcggagggatggcaggcacccaaaggataccatgtattaggaacatggagctccaaaggatatcctcattatttagacacagacaacaaaatcacaattcccggtgatgtattgacaatcatcaatacgaccttgaaggaaggaggcacatgccctaagcaataccgacaagccatagattttgaaatcaatgatccggaagggcgcaatgcggaagtatccatccggataattggaggaaccagcggtgcagcgagcgcctttggctattattgctatagggcagacgcatctttaagtgaaattaaaaaagcccccaaatgcattgtttttccaaacactctgatggataattattataataaaaaggcttccggactacaaggcggtgaaagtgtaaagcttcattacatagaccccgacggagtggaccaaggcaccgtatttcccaatggagtaaaaatcggatggttcctattgaatgacagcttctatggcggaaacaataagcctttctactctactacaaagctgaatggggacggccgtacacatacagctgcattccgcatcgatgattttgtcgtattgtcctttgaagattggacagaccaagactataatgatatacaattcaacgtatggtccaaccccatcgaagccatcatcaatccggatattcctgatatcaaacctgacggtggcaacgaggataagaaatacagtctggaatacaaaggaatcatcgctttcgaagataattggcccagaaagggtgactatgacttgaatgatgttattgtaaaataccagtccgtattgaacttcaatgatgccaatcaggtcctttctacagaagacacctatgagttgctttggtccggtgccactttcaaaaatggtttcgcttaccaactgaatacagaacgcagcaatatgtcaactgaaatattggaagcccccacaagtttcaacggacaaggactggatacagacctttccaaagctaccgtcaatgtatttctaagtgcgctcgatgtaacagagagaaatacaaaaaccgctacatataagataaagaacaccttcaagactccactatcacacgaaacgcttggaattcccccttataatccattcatcatggtacatgacgaattggaagaatcacgcatcgaagtgcatttggtcaactatcctcctactgaaaaggcagacatggctctattccataccgaagaggatttgtcctctgtaccgacaagctattatgtagccaatggcaactatccttttgccattcatctaagtggagccacaaacttcaatactcctgaaacccagccgatagacaagagctttgaacattttatggattgggtcaattccaatggaacagattataaggattggtacaaataaccgataaaagatactccttataaagaaaatggcaaccattcacagggttgccatttcttatatcttcctatgttgtaatatagtagagcgaacttattccaccgttacagccgtaccgcatgccgtaaccatcaacatgctgccactgcctcctaccgtttcatagtccaagtctacaccaatcacggcattggcacccatagcacgggcatgttcttgcatctcgcgcaaggctatatctttagcttcgcgcagcacttcttcataagagccacttcgcccacccaccacgtcgcggatgctggcaaagaaatcgcggaatacattggcaccgataatcgtttcaccggaaacgatgccataatagcgggtgatacgtccaccctcaatagtcggggttgttgttactaacataattcatttttttagttgttgacatattagacgcaaggaatgaaagaaaggttgcaaagctttgctttggtcagaacatccggctgacacgaactatacctgccaccagcacatctatctcctcccgggtattgtaaagcccgaaagatgcacgcactgttccttcgatgccaagacgctgcatcaatggttgggcacagtgatgtcccgtgcgtacggcaatgccaagacggtcgagcaatgtacccatatcaaaatgatggatatcacctaccagaaacgatatgacactacccttgtcttctgcctcgccgaagatacgcataccgggaatctctttcagccgttgcatggcatactgggtcaattcgtgttcataggcggcaatcttgtccatcccaaccagcgaaacgtagtccaaagctttggcaagtccggtagtaccgatataatccggcgtaccggcttcaaacttgaagggcaattcattgaaggtagtcttttcaaaagatacatgctgaatcatctctccaccgccctgatagggaggtatcctatccagccacccctctttaccataaagcacccctacccccgtaggaccatacaccttgtgcgcggagaaaacgaagaaatcggcatccagatcctgcacatctaccggcatgtggggaatggactgggcaccgtccacaagcaccggaacaccctgctcatgggcaaaagcaatcatctccttgacgggattgaccgtacccagcacattggaaacatgcgccacactgacaatcctggtacgttcggagaacaactgcctatattcgtccaataagagttcgcccttgtcattcatcggaatcaccttgatggtaattccacgcttggcggcaagcagctgccagggaacaatgttgctatggtgttccatcacagaaagaatcacctcatccccctcctgcataaattcctcaccaaagctggagacaagcaggttgatactctccgtcgtaccacgggtgaagacaatctcattcgtgctgcgagcattgatgaaacgtctcaccgtctcacgcgaggcctcgtgcagctctgtagcctgctgcgacaggaagtgcactccgcgatgcacattggcattcaccgaataatattcgtccgtaatggcatttactacctggcgaggtttctgcgtagtcgcgccgttgtccagatagaccaacggcttgccatatacctcacgggaaaggatagggaaatcagctcgaagcctctcccccagcccctctcccatagggaggggagccaagatactactcttatttatatcgttgttcataatgaatcgaaattataagctatcacttgcagatggcgcacccctggcatttgttcagttccccccggaaacgcttctctaccagcagatgcagacggtctttcaaagcatccaaacggatggtgtcgataacttcgttgacaaaagcgaacatcagcagcaggcgcgcctcgcgcaccgggataccacgctgccgcatatagaagagagcgctttcatcgagctgccccaccgtagcgccgtgactgcacttcacgtcatctgcataaatctccagctgaggctgggtgtacatatgtgcatctcgggtggcacaaagattgcggttggtctgttgcgaactggtgtgctgtgcgtcagggcgcactaaaaccagaccggcaaaggcacctacagcctgctcgtcaaggacatacttataaagctcattgctggtacagttgggcacggcatggtcgattgtcgtatgattgtccacatgctgattcttgtctgcaatggccataccgcacagattcagctccgcatgttcaccggcaagcgtcacacaggttgtattccgtgtagttccgttgtgcaaggtcataccattcagcaatacattactattggcttcctgccttacatacatattgctgatacgtaccgtactggtgtgtgtctcttcgagttcataaaaatcgaaaatggcattctcaccggcaaagatttctatcacctgcgttgccaggaagttcacgccgtccatcgcatggtcacacaccaacaagcgggcttgtgcaccctcctccagaataatcagcacacggcggttcaccataaaattgacgtcaccacgcaggatattcaccagctgaataggtttctctaccaccacgttcttaggaacataaaacagaacgccgtcttgtgcaaaagcggtgttgaacgccgtcaccccatcctctgccgtatcagccaacttgccataatatttcttcaccaaatcgggatgtttctcggccacctccttcaggctgccgaagataaccccttcaggcagatgggacttaggcaaagccctgccataaaaagcatcgttcaccacaaaataaagagcagtgctcatattgggaacatcgcacttgaacacttcataaggattcaccggaatttccaaccggttcaagttcaagccataatccggctcaaagaacttgctgatatccgtatatttgtatttctcctccttacgggtgggaaagcccaagcgctcaaagtcagcaaaagcagcggcacgcggcgcattcagcacctcggcactatgccggcatatcatcgcctccgtttgggagaaaaggtctatgtattgttgctctacactcatgttttcagattatgagtttataattcacctgcttctttccttatccaatcgaagccacgtgtttcaatctccttcgccaattccggtccaccggtctttacgatacgtccacccagcagtacatgtaccgtatcgggtttgatatagtccaacaaccgctggtagtgggtaatgaccatagcactggtttccgcagtcttgagtttgttgaaaccgtcggccacaatacgcaaagcatccacatccaatccggaatccgtctcgtccaaaatagcaaaagtcggttccaacatcgccatctggaatatctcgttacgcttcttttcaccgccgctgaaaccttcgttcacgctacggttggcaagcttgttgtccaactccacaatggcacgcttctcgcgcatcagcttcaggaactcactggccgacaaagcaggcagatggcggtacttgcgttgctcattcacagccgcacgcatgaagttcaccatcgacacgcccggaatctctaccggagcctggaaagaaagaaagattccttcatgtgcacggtcctcaggactcatggcaagcaagtccttgccattaaaggtaattgagccgcgcgtcacttcgtaagcaggatggccaaccaacacattactcaacgtacttttaccagcaccgttctgtcccatcagtgcatgtacttctccatcacgtatggtcaagttgatgcctttcaatatttctttgccattgatgctggcatgcaggtcttttatctctaacatctttatatttactatttgactatttacaatttactatttataaatcaccccacgcttccttccagcgaaatggcaagcaatttctgcgcttctacggcaaactccatcggaagtttattcaaaacctctttggcataaccgttcacaatcagccccacggcatcttccgtagaaataccgcgctgattgcagtagaatatctggtcctcactgattttgctggtagtggcctcatgctccacgatggccgtttcattgtgaatatccatgtaggggaaagtatgcgcgccgcatttgtcaccaagtagcaaggagtcgcactggctgtaattacgagcattgtccgctttctgtgccacgcgcaccaagccgcggtaagagttttcgctctttccggcagaaatgcctttgctcacaatggtgctccgggtattcttgcccagatgaatcatctttgttcccgtgtctgcctgctgatggttattggttactgccacactatagaactccgctgtcgaattgtcgccggaaaggatgcaagacggatacttccaggtaatggccgaacctgtttccacttgcgtccaagacagtttactgtccacccctttacaatggccacgcttcgtcacaaagttatagacaccaccccggccctcggcatcaccgggataccagttctgcacggtgctgtatttcacttctgcacggtcgtgcaccacaatttccacaatggccgcgtgcaactggttctcgtcacgcatcggagccgtacacccttccagataagaaacgtacgaatcatcatccgccacaatcaaggttctttcgaactgccccgtattgcgggcattgatgcggaaataggtggacaactccatcggacagcgtacccccttcgggatatagacaaaagaaccgtcggagaacaccgccgagttcagtgccgcaaagaagttgtcacgataaggcaccaccgaaccgagatatttctgtaccaagtcgggatgctcgcgtacagcctcgctgaacgagcagaagatgattcctttctccatcagcgtctccttgaaggtagtctttacagacaccgagtccataacggcatccacagccataccgcttaacgccatctgttcttccagcggaatgcccagcttattgaaagtctttatcaactcagggtccacctcatccatgcttttcggtccttccttcttcttcgtagggtcggcatagtaggatatggcctgataatctatttcgggaatgcggagatgtgcccatgtaggcatctccaatgtcagccagtggcgatatgccttcaggcggaactccagcaaccattccggttctcccttcttctcagagataagccgcactacatcttcattcagcccgcgctcaatgatgtctgtatgcacgtcggtcgtgaaaccgtacttatacttctcctgagtgagttcctttacatatttattgggttcttcttgttgcatcacttctataattacaaattatgaattacaaaatcacggttcacggtatcagtcaaagtctccgtttacaatctgctccgtaaccgcctttgccgcgggaaagaatatcccggcaaactcttccataggataatataacactgattctttcttttttgttttgctaatcagcgtattgtctccgtctataaattcgatgacaccaatcagcaggctcgtcagcaggaggtacttcaaagctcctagaccagcccccaaccaatgattgagccagcccagcgagacggcctccattgcccgggtcagcagagaagccaccagggagaagagcaagggaacagccagccagatgaggacaaatgccagtacttgcgccactgtcatagagtctgtcaacgtggggcacagcttcactgccaacgaggcatacaaagcctttgccgccagcagaccgacaatcagccccagcaaagaggccaattgcttcacaaaacctttcatgaagccaatgattgcgcccaagccgaaagcagccaatatgatgatatctataattgccatagattaatgtgataatgtggtaatgtgccaatatgctaatgagcaaatggctgatatgcaaaatgtgccaattgccctgcggcattttctgtacgcgcagccaattggcacattagcatatttgcacattattcaattataatgtttgcttcacttctatttcttcgtaagattcgataatatcgcccaccttgatatcgttgcagtttgtcaggctgataccgcactcgaagttggtacctacctctttcacgtcgtccttgaagcgcttcagggcattgatggcacccgtaaagattacgataccgtcgcgtatcaagcgggccttgtcgctgcgtttcacctttccggtcttgaccatggcacctgccaccagtcccaccttcgtgatgttgaacacttcgcgcacctcgatggttgccgttatctgctccttcaatgtcggtgccagcataccttccatggcagccttcacctcttcgatggcatcgtagatgacggagtacttgcggatatccacaccctcctgctctgccatcttggcggcagcacccgaaggacgtacctggaaaccgacgataatcgcatccgaagcggcagccagcgagacatccgattcggaaatctgaccgacacccttgtggattacgtttacctgcacctgctccgtagacagcttgattaaagagtcgctcaacgcttccacagaaccgtccacgtcacccttcacaatcacgttcagctcatggaagtcacccagcgccagacggcggcccacttcgtcgagcgtcagcatcttctgcgtacgcagaccttgttcacgctgcaactgttcgcgtttgttggcaatctcgcgtgcttcctgctccgtttcgattacgtggaacgtgtcgccagcagcaggtgcaccgttcaagcccaatatcagggcaggtgtagaaggaccagcctcctgcatgcgttggttacgctcattgaacatagccttcaccttaccgtagctggtacccgccagcacgatgtcgcccattttcaaggtaccgttggaaacgagtaccgtagccacatagccacgacccttatccaatgaggactcgataatggaaccggtagcacggcggttcgggtttgctttcagctccagcatttctgcttcgagcagcactttctccatcaactcgggtacaccgataccctttttggcagagatatcttgcgactgatacttaccgccccactcttccaccaagaagttcatggcagccagctcttccttaatcttgtcgggattggcagtcggtttatcaatcttattgattgcaaatacaataggaacacccgcagccatggcatggttgatggcttcctttgtctgcggcatcacgttgtcgtcagcagccacaatgatgatggcaatatccgtagctttggcaccacgggcacgcatggcggtaaacgcctcgtggcccggagtatcgaggaatgtaatcttacgtccgtcgtccagcgacacgtggtaggcaccaatgtgctgtgtgataccacccgcttcaccggcaatcacattcgccttacggatatagtcgagcaatgaagtcttaccgtggtctacgtgacccatcaccgttacaatcggagcgcgaggttccaaatcttcctcatcatcctcttcctctacgatagcctgcgccacttctgcacttacatattctgtcttgaagccgaattcctcagccaccaggttgatggtctcggcatccagacgctggttgatggataccatcatgccaatgctcatacaagtggcgatgacctgagtaacagaaacatccatcatgcttgccaactcgttggccgtcacgaattccgtaatcttcagtaccttgctttctgccatttccatgtcttccaattcctgcatacggctggaagccatgtcacgtttttccttacgatacttggcacctttgttctttcctttggaagtgaggcgtgccaaagtttcctttacctgctttgctacatcttcctcgctaacctcctgcttgatgaccggcttcttgaagcggtccttattgcggttgcggttattattggcattgtttccaccaggctggtttccaccttgcgggcgggcaccctgaccttgctgggcacctgcgtgtccacggtcgttgccaccacgctggaagttggaagcattgttgatgtccactttctccttattgatacggacacgtttcttcttgccgttggcatcaccggcagcggtatccttcaacttgctgtcatcacggcggatttccttgatgatagcttccttcatctgcttcttctgatcctgacgaatcttttccttctcttcacgctccttgcgtttctcctctttcgatttcttctttgggcgtgtggattggttcagggccgccaagtctatctgtccgataacattaatcttcgaaacaaactcaggctgatgtatcttgaagatttcttctccttcttctttcccctctttttcaaccggtgcttcttcagctgccggtgcgggagcaggcgcttctatcatttcttcctttttagattcttgttgagcctctacaaccggagcaggctcttccttgacaacgggttgtggctgcggttccgaaacgggctgcggctcgggctcagatgccggctgtacctccggttgcggctgtggttccggttggggagcaggagcaggttccggtttcggcgtttctacaactgccggttcctccaccttcttctcctctaccgctttttccgcttctttctctttttcctgagcaggagcaggtctacggttcagtttgtccaaatcaatcttgcctaccggcttgaacttcggacgtgcgtcttccggaacaaccgtcttaatctcttcgggcttcgctttctcctgcgtttccctatagccgtcaatagacacggacgccttgttgcggtccttgctctgacgttcctggctgaaacgctccgactttatcttaaggtccttatctgtactaaactcctttttgagcagttcgaactgttcatccgtaatttttgtgttcggatttgcctcaacggtaaatcccttcttttgcaggaactcgacagccgtcgtaatccctacatttaaatctcttgttactttgtttaaccttatcgtcatcaattttttctatttacgatttaaccatttacgatttacgattgataatactcggagcggaacgacttacatttacaatcaaactctaatcgtaaatcgtaaatcgtaaaatcgtaaatcattcattctcctcttcaaactcctgtttcaaaatgcgcaatacctcgtccaccgtctcttcttcgaggtccgtcttctcaatcaacatctcacggggagcgttcaacacagccttagccgtatcgataccgatagccttgatggcatcgataacccaaccgtctatttcatcacggaattcgtccaagtagatgtcttcatcctctatggcctcatccaactcacggaacacgtcgatggtgtactcagtcaacatactggcaagcttgatattcaaaccgcctttaccgatagccagcgacacctcttcgggtttcaagaacacttcagccttgcgttcttcctcgttcaagcggatggaagaaatcttggcagggctcaaggcacgctgtataaacaactggatattggacgtatagttgataacgtcgatattctcgttgcgaagctcgcggacaataccatggatacggctacccttcacacccacgcaggcacctaccgggtcgatacggtcatcgtagctctcaacggcaatcttggcacgctcgccggggatgcgggcaatcttcttgatggtaatcagtccgtcattgatttcgggtacttccatttcgaacagacgttgcaggaagacgggcgacgtacggcttaggataatcttcggattattattcttgttgtccacacgtgccactacggcgcgggcggtctcgcccttgcggtagaagtcactcggtatctgttcggtcttgggcagcaacagttcgttgccttcatcatcgagcagcagcatctctttcttccaaatctggtagacttccgcattgatgatggtacccactttatcaatgtatttgttgtaaatactatctttctccagttccaatatcttggaggccagtgtctggcgcaagttcaagatggcacggcgaccgaagttcgcgaagataacttcatccgtcacttcctcgcccacttcataagaagcatcaatcttttgtgcttcggacaatgcaatctgcaggttcgggttttccaaatcctcgtctgccactacctcacggttacgccatatttcgaagtcacccttgtccgggtttacaattacgtcgtaattctcatcggtaccgaacattttcgcaatcacactacggaacgactcctcgagtacgcttaccatcgtggttctgtcgatattcttcagttccttaaattccgaaaatgtatctatcaagctgacagtttctacttttttggccatagtcttatttaaaactgattaagtatttagtgtattttatctcttcatacgtaaaggtcaagtcctcgtccaccagcttgggacgcttggcaccttcctctttcactttcttctgaatggtcacgacgaaatgctgttcgtcggcttccttcaacacgccgctgagcttgcggccgtcctttgccagcacttccacttccttgccgatgtggttaatgtactgctgcagtaccttgaagggctgtccgatgccggccgaaccgacttccaactcataatcctcatcctcacggttcaacttggactcgatgtagcggctcagctctacgcagtcctcaatccaaacaccttctttgtggtctatttccaccaaaatcttgtcatccgggctgattgtcacctccacaaggaagtagtcctttcctgccagccactcgtcaacaatctgacaaacagttttcttttctatcatagattaaccattaggaacaaaaaagaggagcttaatcgcccctccacctttcatccgttttcggttgcaaagatataaataatctgttcgactacaaaatattagagaaaaaaagattgatttaacggttcaaacgggaattatattacaaacacaccctttcaacacttcaagataaggggtaaaacatataatcttatgagacagaagcttatactttatgaaatgaattatcacgttccatactgcatgagatgcacatgtcaagcacaacgagatgtgcatctcggacaacatgagatgtacatctcaagcatacaatctctattgtttcaggaaaagaagtaaggagatacaaacggaaagaagatactgttgaaagacaacgcggaaaaataaaaggccgatagcttgtttcatgctatcggcccttttactatggttctaaaggtctaaaagaccttgtcgtatcacttattcggagtctcccacttcttggtatccgtacaaaccacgttcaccgtttggtcacccgtctggatgcggaagtcacctttctccagaatccacttgccatcatagcctacgaaagcaaggtcggagcctttcagtttcagagtcacggtctttgtctcgcccggtttcagttccactttctcgaaagcgcgaagacggcgggtatcgggagtaagggaggcaacgaggtcactgctgaagagcaacacgctctccttgccgacacggtcaccggtattcttcacatctacagtgaaagtaagcacatcatcagcggtaaagtccgacttatccaccttgaggttactgtatgcaaaagtagtataactcaatccataaccgaacgcccactgtacagatacttgcgcatcgtagttataagcaccttccatctgcttgccgatgtgttcgcacggtttgtagtcgtacgtaatcagagagttgatttccttcggataagtgaaaggcatctttccgctgaagttggcgtcaccggcaatgaggtttgccaacgcatcaccgccgtagttgcccggaagcatagtattgacaacagccttagccaaaggctcgatgtcagcaatcaggcgaggacgaccttcgttcaacaccagaatgatgggcttcccggtcttggcaagagccttcaccaaatcgagctggttctgggagaggaagaggttcgtcaggttacccggagtctcgcagtaagagttctcaccgatgcaggcaacgatgtagtcggcaccggcagcggcagctacagctttctctatctccggagtgttttcttcccaccagttgccaccttgcttataagtgacaccggcttcgtaaatgatattgtccgcaccgaatttattggtgaaggcttcaagaatcgtattgtattggcttgcatgctcgtcggccttgtcgccctgccatgaataggaccagccaccgttgaggcaacgcatggaattggcattcggaccggtaaccagcagtttcttgccttttgccaacggcaatataccgtctgtattcttcaggagtaccaaagactcttcggcagcctgcaatgcagcagcggcatgttccgcactaccgaacaacgggaagtctttcaagtcataatagggcttttcaaataggttgagacggtacttcaaacgcagcacacgacgtacagcatcgtctatacggctcatggaaacttcaccttcttccaccagctccttcaagagtgtacagaacttccagtcgtacgggtccatagacatgtcgataccggcattgatggcgagcttgatggcttccttcttgtccttggcaatgtggtcgcggctataaaggttgttgatgtccgcccagtcggtcacgatcataccgtcccagttgaggtcttctttcagccacttggtcagcagctcatagttggcatggaaaggcaggccgttgttcatggcggagttcaccatcacggagagggcacctgccttcaccatttccagataaggagcaaaatgcttctcacgcatatcctgctcggtgatggaagacggcgtacggtccttaccggaaacggggacaccataacccatataatgcttcatacaagcggcaacgttgttcccgccaatcaggttggggttctctccctggaaaccgataacggcttcacgtcccatttcggcattgacgtaggcgtcttcaccatagttttcccacatacgcggccagcgcgggtcacgcccgaggtcggtcaccggggcatacgtccagggaatgcttcccgcctttgtttcataagcggagatgcgtgcaccttcacgtgtcagttcacggttgaaggtagctcccatattgacgccttgcgggaagaaagtaccacccagcgtataggtagttccgtgtatctggtctacaccgtacacacaaggaatacccatcacctccatggatttctcctgaatgcgtttgatgatttcctgccacttctccacgctctgtgccacaccgttgggcacgttcaagatggagcctactttgtattttccgatgacagagtcgagcatcgcctcatccaactggaagcccttggcattctcaatgccttggatacgcatatagagcttcatcatcacatcctgcgaaggcatctccttgcccagcttgaattccttttcaagcttgtatctcttgatgattttttgcaggtccttcaccgtgatgttcttcgggtcgaggccggcaaagggattggcgcgtttctgcaggaggtcgatagtgagttcgcacatctgaccgactttctcgtcaagcgtcatcttcttcagcaaagtctcaatctgctgttctattttctcgtctcttggaatggcaggcgcaacagtggtctgcgccgtagcagtaagcactaaccctgatagggctaaagataagattaactttttattcatggttgtgatattggtttataatagttgcactatctgtttatacgaggcacaaagataagaacatcctgccataccaaagggtacaacaggatgttttttagggtatgatttgttatcttttcagacaatcctactctcatctcttcaagaggctcatcggttcctgaagtttcaagatgttgttcgtcttctgcgttgcggcagctacttcagcctccagcgtagccttgatgtcgcgtgaggaagccccgacgaggaacttgtagtttccgggagttaccacccatgccgatgcagcctcatcgtaggaagccaggtcatcagcattcactttcagcgtcaccacaaccgcttcgcccggtttcagctccttggtcttggcaaaagccttcagttccttttcgggcttgttggcagcaacatcgggagcggatacataaagctgaaccacttccttgcctgctaccttaccggtgttcttcacttctacagacacggtatagacaccgttgtctgccttgacagcagccttgtcgtaagcaaaagtggtataggaaagaccgtaaccgaaaggataggaaacctgcttgccaaaggtgtcgaagtaacggtaacccacgtaaatgtcctcttcgtaattggtatagtccacgttcttcacgtcgttcttcttcccgcctttgttcatgaggtcggtgctcacacgcatgtctatcgggaagttgtcggaagaagcggcatcttcaaacttcaccgggaaagtcattgtcagcttgcccgaaggagaagccttgccactcagcacgtcagccacactgtttcctccctcctggcctgcctgccatgcacaaagaatggcatcgggagcagatttccaagaagcggtttcaatcacaccaccgatattgagcactaccactaccttctttccggcagcgtggaaagcatcggacacagctttcaacatgttctgttcctctttggtgaggttgaagtcggctaccatacggtcgagaaactcaccggaggtacgtcccagcgtcaccagtgccacatcggccttggcaacctgctcgcggataacttgtgcggacacagccatctcagcaggacgctcgtcgggcataaaccactctttcttatctttggccagacgttctttctctgctttcaggtaagcttcatagctattcttcagcgcttcatccaccacatagccggcattcttcaagccgtccaatagcgaaacggtataagcgcggttcacgttgcccgagcctgtacctccggcaatgaagtcataggaagtgcaaccgaagagtgccacgttcttcacgtcggcagccagcggcagagcaccgttatcgttcttcagcaataccatgccttccgttgccgactggcgggttacggcagcatgcgccttcaaatcaggcttgttggagtatttatatcccttgaagtggggagtctggagaatcatctccagaatacgcttcacattctgattgaggatggcttcgtccaacgctccgtcctgcacacccttcacgatggcttcgtactgcttgggcagaccgggctgcaacatgtcgttgcctgccaccatctgtgccacggcatccttgccgccaaaccagtcggtcatcaccatgcccttgaagccccattcgtcgcgcaacatcgttgtctgcaactccttgttttccgaagtgtagacaccgttcaggtagttgtatgaggacatcacggtccaaggagcggattccttcacggcaatctcgaaccctttcaagtagatttcgcgcaaagcgcgtggagatacatgcgcatccgtagccatacggttggtttcctggttgttcacagcaaagtgcttgatactggtacccacaccgttgctctgcacaccacgtacgtaggcggcggcaatcttacccgacaccaacgggtcttcggaataatactcgaagttacgtccgcaaagcgggttacggtgaatgttcagcgccggagccaacagcacgtccgcaccgtattccagcacttcgttaccgatggattgacctacactttccaccagttcctggtcccaggtagaggcgagcaaagttccgatagggaaatgagtacaatagtacgtagccgaatccccctcacgcttggggtcgatacgcagtccagcgggaccatcagccagcaccacagcgggaataccgaggcgttcaatcgggtatgtggttcctgccgcacccggcaccagctttctcgttgcaccgattacggcactgtcacccgagaagcctgccataccggtacccactaccagatgcgccttttcttccaaggtcatggcgccaatcacctcatccagagaggactttccaagctgcggcacacccggtccgcaagctgacaaaacagccattgctgctgccatggatatgatattcttcttcataatcttatttaaatatcttcggtgcgaattctgtcaggtaaatacgccagttcttccagatatgaccttctccggtttcataatattcatatttgtaacccttctcgtccaacatcttgcggtagtcgctgttggcttggaacaagaagtctttattaccgatagcaatgtaatagagtgccggtttcttggcaaactgggttttcagtttggcttcaaggttgtcataaatcggagacttcacatctttgttgggcatgatggctgccgagaacagccctacatagtcgaacatatccggatattgcttggagatgtgcatggagtggtaaccgcccatagacaatccggcaatggcacgccccttcttgttggcctgcgtacggtaagtcttatcaatgaacttcaccacgtcggggaaagcagtctcaaaagagccttccatcgtcttgggcagattcatgctgggagcggcaaaacccaatgacgattcacccggagcagcctccaatgcggcattgccgttggtcattactacaatcatcggcttggccttgccttgggcgatgaggttatccagaatctgtgccgtacgtcccagttcgctccatgcgttctcgtcgccacccatgccgtgcagcaggtagaagacaggatagcgcttgccgcttgtctcatatccggcaggcgtatagacagtcagacggcggtccatacccagcgtagggctgttgtaccataccttagataccgttccatgaggaactttattcactttgtaaaggtcgatgcgctcgtcaccaccgatgatgaatacattcgtcacgcttgccacgtctcgaatcatatagacgttggcagggtcgttaatcttcagtccgtctaccaggaaagtgtagctgtagagttccggtttcagcggttcgggagtagtgaattcccacacaccgtccttgttctctttcaaatctgccacacccggaccatcaaactcaccaaaaggagtcttgattttctgcgtaggcaggaagtcgccggttacttgcacctttacggctttcggcgccttcaagcggaaagttactgtattgttgtcgtgtatctcaggtgagaccacgggagcgcctccccagagagcttgttgcgcgaaagtcatcgcacacatcagcaacagagctgacaaaatagaaattcttttcatgatacgtatgttattttgttattaaattagttataccaaatcctcttatttgaacaacttcggcgcgaactccgtcagatagattcgccagttcctccagatatgtccctcgcccgtttcaagatactcgtacttataaccattgtcgtcaagcaacttgcgaaaatcggccacacctttataaacaaagtccgtcttgccgcatgcgatgaagtaaagagccggtttcttggcaaactgagtcttcagcttaccttcgaagtcggtatagaccggacaagtcgatttatcgtttccggtacttgcaccggagaaaagacctacatagtcgaacatgtccgggtaatacttggaaatattgcaagagtggaaactacccatagaaagcccggcaatggcacggttcttcttattggcaagagtgcggaaattcttctccacgaacttcacgatttcggggaacgagagttcaaaagcaccttccgccaccttcgctctttcgtcgggacgcatggagggggcaacaaaacccttgggagattcacctgcagcagcatcttgccaagcattgccgttagtcatcaccacaatcataggtttagccttgccttgtgcaatgagattatccaatatctgcgaagtacggccaagagcaatccaagcttcctcatcaccacctgcaccatgaagcagataaaataccggataacgcttgccgctggtttcataaccagccggagtgtaaatcgtcagacggcggtccattcccagcgaaggactattgtaccacatgcgacttaccgttccatggggtaccttattcactttatacaaatcggcacggtcaccaccgatgataaatacattggtcacggtagccacatcccgaatcatgtaaacattgctcgggtccatcattctcaatccgtccacaataaaggagtatccataaagttccggcttcaatggttcgggagtagtaaattcccaaacgccatccttcccctctgtcaaatcggcaatgcccggtgcatcataatcgccacgaggagtcttaatagtttgtggaggcagaaaatcaccggtaatctgcacccttacagccttaggagctttcaagcgaaaagtaaccgtgttgtcgtcatgaatatcaggagagacaactgccgcacctccccaaagagcttgctgtgcaaaaagggtgacacagcagaccagcagcatcgctgccaaacttaataatcttttcataatttcttatattaaatgaattagcttcttgttatttagcaaagcagcgacttacaaaaggcaggcacatataaagtgccgaatgccaatattcgctggtatgtccgccatcccgcacacggaactggcaagggataccggcattacgcatcgcctggaaaaactctatattacggtccagcagaaagtcatcgtctccgcaatccacaaaccactgtacagtacgaagctgtgccttacgcgcaacatctgcctcagccacatacctgatgcaactatgctcctgcacagaacgcgtcagtacagccatcttgtttgtggggtcggggtctcttcccacctcctcaccactaacggggatgttcatcaaagcactcatagcataagcagcacaatacatatccggatagcgctgtgcatagcttgccgttccacctccgcccatagaaagtccggcaatggcacgatgccgcttatcacctttcacccggtaagtcttctctatataaggaaggaactccttatagaagaaatcttcgtaagcccaacccggcatgttgaagtagccgttccagcaagtagccggattgcctcctgcattggggctgacgataatcatctcgcaagcctcgcccgatgccaccaactggtccatcacgtccttcacacgttggtctgtaaaccaactggtattcacccccgacatgccgtgcagcaaatagaggataggatatttcctatccgtttcattgctatagctttgcggcagatagatggtgtaggcacggtgtgctttcaatacctggctgtagatgctgtcggtcactaccttgctttgcggtccccatgcaggattttgtgcatttgccatccacagcaagcagacggcaaaaagagagagtatcaatcttttcatggtatcgatttaaaaatgtactacaaaataagcgttttccactctaaaactaattgatatatatcagttttttcacgcatatccccctcatctcttcaccatcggatacacagccacaggcacttgcgcccgcatggcatcatgcactttctgcttgcgtgcctttgtcaccctctgtaccgctgtgcaacgcacatcggccgaagatgcggcaaccatccactgatattcacccttagccaactcccaagagctgtttttctcattaaaggaagccatgtccatcacgttccaagtcagaatcagtgtctggctctcgcccggctggagcaaggcagttttgccgaaggccttcaactccttggcaggcttgtcaagtcccccattcggagctttcacatagagttgtacagcttcacgccctgccaccttgccgatgttcttcacgctcactttcaactcacagcgatcggcatccattttggcgttctctaccgcatagtcaaaagcagtatagctcaaaccatgaccgaacggataggaaacctctttaccgaaagtgtcgaaatagcgataacccacatagattccctcttcatagttggtgaaatccacatttttctccggttccttcggtttctcctctttcttttcggacttgaagttcatgccggtacccatagcaaacgacggcatcttgaactcgtaatcaaaagggaagttagcatccgacggcgcatcgccatatttcacggcaaacgtcatgggtaacttgcccgaaggattcacctttccggtcaggatgtccgtgatacaattacccacctcttgtcccggctggaaggcacaaaccactgcatctgccagtcccttccaagaagcagtctccaccgggctgcagatgttgagaaccaccaccagtttcttgcctgcagcatgataagcggcagacacttgcttaatcagagccaattcgttctccttcaggaggaaatcttccacacggcggtcacagccctcgccactgacacgccccagcgtaagcacggcaatgtcgttggccttcacttgtgcagccagttcctcggcagtgggcaggaactcctcggcacggggcagcggagtaaaggcgaaaggcggttttccgtgaggaaaaagccgtttctgctcgtccgccatatgcttcttgtagcgattcagcaattctttgtccacgatgtaacccgcattgcgcaaaccttctaccatagaaaccgtgtaatagccgatgcccgtactgccaaagcccatgccggcaggaaccatgtcataggaagtagttccataaagggccacttttttgatgccggcagccatgggtagcgcctgcttgttatccagcagcacgataccttccgcacctatctcacggtctacttgcgcatgagcctccaaatcggttttattgggatactcgtagccggcaaaggtatggctcttgaccacaaactccagcacacgcttcacgctgcggtcgaggagtgccaaatccagtgtaccgttctctacggcttccaaaatagctttatactggcggtcttgccccggttgcagcatgtcgtttcctgctacgatggaggtcacggcatcttttccggcattccagtcggacatcaccagtcccttgaatccccattcgtcgcggaggatgtcctctgtcagttcgcggtcctcgcaggtatatttgccgttcaccttattgtaggcggtcatcacgctccagggctgagactctttgacagcaatctcgaagcacttcaaatacagctcgcgcaaggggcgctgtgtcagatgagaatcgttgttattgcggttggtctcctggttgttcacggcaaagtgtttcaggcaggtacctgtcccccggctctggactccgttgatataggcagcagccattttaccagccaacaccggatcttccgaataatattcatggttacgtccacaaagcacatttcgcatcaggttgacacccggtgccagcaacacatccaaaccataatccttcacttccatacccaaagtacgtcccaccttatgggctgcatccggattgaaagtagctgccaccgtggtgctggaagggaattccgtagcatgataagtacggctgtcgaattcccgcttggcagccatcgccaaccggtgcggtccgtcggcaagataggcggaagggatacccagtcggggaatgtcgtaagtacgtcccgctgttcctggaaacttggtatcacttcccatcgacattccacaaccgatgacgaggtgtaccttctcttcgagggtcatggcactgaccacttcgtcgacattgtcggcacgcagtctgactgactgattcgaaccggtcacctgtgcagtcaaagcagatgccagacagagtgaaaataaagtaattgacaatcttctcatatatattatatttaaaaagccacaaaagaagcccccgtacaattagctgattcccacgggggacttcttctacaaacaattaatcagttagaaaaatctaattttgtctatctgcatcagatgacgaagttagattttgattctttatacgctttaccaacctgcattttgttccatatttggattcaaacggatctcctttgccggaataggcaacaaataatgtctttccttgaaaccataacgcgttttatccttgttatactgaatgtattctaccgctacattatccggctcatcttttcctgccttatttgacaagataggtgttctttcaccctgatccttaagcaaagcctccgcatctttccaacggataatatcctgataacgggtatattcagaacagagttccagtctcttttccaatttaatggcatccaaggtagccgtctttgcatccaatcttgcacgctgacgcacctcattcaagcaagcatcagcttcggattgattgccatccttcaggtttgcttcagccgccagtaacaagacttcagcataacgcatccaacgatagttattatatgaacaccagaacccagcaggagattctacattcgagaagcgacgcttccacatgaaataaccttcattaatcaaactctgccctttggcaaccttgacacccaattgagaaatttggtcataggttttcattgtctgattcaaccgataaccatctacaccctcttcctgaacaaatgcatcatacaactttttctgaggaaccataaatccccatccggtaccattaaactgattgttagagccagacatatccaacttatcagtgcgccaatgattcatcacctcaaagaaactgaactcatccatggaattacttgcatcaaaaatacggttactttcgagcatactttcacaattatactcagccttgtaggtcaagatatcctcataatttccatcataaagtttatacttaccactagctctaacttcattcaagacaacagcagcttcatggaatttttcttgccataaataagctttacccaatatagcttgtgccaactgcttggtaacacgccatgtcgttttatcatctacactcttcttttcctccaagagtcctgaattgatagcttcagtcaggtcccgctctatcaacgcccaaatatcagccttaggcgaacgagccaactgatattcggatttatcaagttcatggtctaccaatggtacatcaccccacatagaaactaaatcaaaataagcaaaagcacggaagaacttggcttcagcacaagccttcttcttcaaatcagtatcaggctcaacacgtcccagaatcacattcgccttataaataagctgatagtagctttcccatacgcctccgataaaactttggtctgagccaaatgaatattcattacagccttccagctctgcattgtcattacgaccaccaccacctgcccaaacatcgtccgaaagggcattcttcatcatcgtatagttatagtatgtacccttgagttgtatataaagcgcatcagccgctgcttgagcttgttcgtcagttttataataagtggaaaagtccaatacacctttttgaggtatatccaatttgtcttcacacgaagtgccagccaatataaggagcgctccgagcattaaagaatatcttaatttcatatgtttttcattttaataagttcataaaaatcagaatgtcacactcaaaccaagaacaaccttctttgaattaggataactacctttatccacacctaatgaatttccgacaccggtaacttcagggtcaaaaccaggatagtctgtaaaagtaaagaagtcctcaagtgagccatatatacgtagattttcaattgctaccttcttaatcagttgcttcgggaaagaataacctaactgaatctgtttaattttaaaataagaaccgtcaaatacacaaccggaagaagtcagatacttggtataatctgtagcgcctgatgcaggagtcttcccattgcgattgctttctgtccagcggttttttgtaaaataagtcagctgattcaaattgtaatccacacggttcaagccacagaacacatcgttaccttgagaacccgtaccaaacaagataaaatcaaatcccttccaagctgcattcaaggtaataccataagtatagtcggcaattcccttaccaatttctgtcttatcattatccgtaataccttctacaccatcaatatctctaaagattggctcaccggtttttgaatccacacccatgaaatcataaccataaaaataccacgcgggcttacctacctcaaaacgagtaatggctccataagtcacataagtagccccatcaatacttgataaagactcatgtatcttggtcactttattcttcaatgtagcaacgttggcacggacaccataagcaaagtcaccaatacgatcttgccatcccagttccaattcaaaccccttgttcgtaatattaccggcattaactggcgagaaactgttacctactacagttgaagccttaatgcccgaaacaatcaggtcttttgtctttttatggaaataatcggctgtaacagtcaaacggctattcaagaaacgggcatcaatacctatattggtttgttcagaagtttcccatttaagtccgtcattaccggtagcagagggagcataaccattgatgtaagagaaattattattatcacctacagccaaatgcccggtagcaccaattgatacattccatttataaccgcccaatgatgcagtagaaccattctgtccccaactggcacggagctttaattgtgacagccagtcttcagttcctttcataaaattttcctccgaaagaacccaacccaaagaaactgccgggaaatagccccaacgtttgttctttggcaacacagagaggtcagcagcatcggcacgcagtgagaactgagccatgtactttccggcatagtcataattcaaacgtccgaagtaagataatttacgagtataggtaggctcaccaccacttacatcctttacagcatcagatgtagcataggcaaagtagaagaaattaggatcattctgcaagaaacccaaatgcgaaactctgttaatcacatttccccacatatctgtagtatcttcattatatcccttcttacttccgctaacgccataagaacggctctgactataagaagttcccaacatcaatgttgcgttgtgtttgccaaaagaacgggtgtagttcaaaaagttctcccactgataataggttgggctataatccgaagccgaaacctccacccaatcacgtttagccttgtcagtatagtaataagattgccccacgccataagaggaagttgaagccaaacgataagaaagacgagaagtaacggtaagccccttgataggcataaaattcaaataagtagaaccattgatattaaagcctctgttcttggtataagagttgtcacgcatggcaaaaggattgatagcttcggcattgccagtgaaagctgatacaccataaaggttgccgtttccatcgcccaacatattcttatgatccttatagatggtagccatattcaacggcaagtcatcaataggataaagaggcttggtcagagggtctaattgtaatacagaaagcatcatgctaccatactcattgccctcggctacggactgagttttgtagtgctcaatctgattattggtacctacctccagccaaggtttgattttccagctggcatttaccattcccgtgagtcgttcataagtatcggcattgccgacaatcataccgtcgttatcaaggtgggacaatgacagatagaaagaacctctgtcgctaccaccttggaaagtcacattatgacgtaccatcgaactgttttcaaaagcctcatcgacccaatccgtatcggtttttccatcccaataggtatcaaaagtactctgggtaagcttcttgttttccaagaagaattccttatactgcgcagcattcattacttcgggtactttacccaaactctgtgaagtatattgaaaatcgtatgtgattttaccgtttccttttcctttctttgtagtaatcaatactacaccgttaccggcagcagcgccatagatagctgcagaagcaccatccttcaaaacttccatagactcaatgtcattagggtcaataccaccaatatcgctggcaatacgtccatccactacatacagcggatcgcaagagccgttagaacttattccacggatacgcacctgtggagaagcacccggtttagcagatgcactgagcacttgcacaccagcagttttaccctgcaatgcctgctcagcacgggtaatggtacgtgcttccatatcttctgattttaccgaagatacggcaccggtcagtgaacttttcttctgcacgccataacctaccaccaccacttcatccagcgttttagtgtcttctttcaatatcacattcattactcctgccactgctttcttttcttgtgtcaggtagccgatgtaggaatagacaatcgtcgctccttctttcacagacaaagagtagttgccgtccatatccgtaatgacaccgttggtagtgcctttctcaaagatactcacgccaatcatcggttcattcaggtcgtcagtaaccctaccgttcacctttatagtctgggcttgtgccagactgaaaggaagacagatcaataggaagagtgccatagctgcaagtctcttccgagctgtttgcttcagattttgtttcatttgattaaattagatttatgttaataataaaaggtttcttaagaaagtgtcagaacccacgtgtaggaaatgccatcactacctccagcagttccttgtcatggttatacttcacttggcaatcgttattgaaaatcatcgttgctcccttttctgcggtataaggttcccactcgggtaacccttcggcattgggattgcccgtacgggcaaagttcaaccacgcgctgctcatcttctcggccagggcctgcgcttcggcgccgccgcccgtcatggaggcgtggactacggcattgttgaaggcgaaaggtatctccatgcagtgcgtgctgcggaacatgccgtcgagcaccggagattcccaggcgaacatgtacatatagaccggagcaccctgctgtgcagctttcagtctggcttgctccaccgcaccgggacggaatacgaaatccacatccaccaaatccttgggccggtagccggggtaagccttctcgaaggcggcgaggaagtcgtccgtgcggtcaccgtagcgttgtttcaggaattccacggctttttctttggtgatggtgcggaaagcgggcacgtaggtgctcatggtgaactcgtgcaaggtggttcctatcatcacgggcacgtccttgctctgtgcaggcgcctgcgggtcgaaaggttgtgcgggcagcacgtcgccatccacagtgggcgcccatccgaagatgaaggtagagatgccatcctctttctcaacctcggccttcaccttggcaacggctttctcaccggcagcaagcagccgttcgtaaggcatcttctgcagctcgtctatctgcgaggctttcaatcccaactcgtccatcacggcagcgccgatgcgacgtgaatacttggcatccatcgtgcgaagcatggagccgctctgaacgatggccttgtggtagagcccttttgcagatggagtggcaagcaatgtggaaacctttccgccgccgcccgactgtccgaaaatcgttacgttctgtgcgtcgccgccaaacgcggctatattcttgtttacccattgaagtgctgccacgaggtcgagcaggccggcattgccggatttggcgtatttgtcgccgtaggcggaaaggtcgaggaagccgaggacgttgagacggtggttgagcgtgactaccaccgcatcacctttcttggcaaggttgaaaccgtcgtaggagggaagttcctgtccgctgcctgccgcatagccgccgccgtgaagccacaccatgacgggacgcttcttgccgtcgttcaggcccggagtccagatgttgacccgcaggcagtcttcgccgggatagccgtcgtcccagtggaaggcgaaagcgtgctcgtcggcaccccagcccatacgcaccgcctgggggcaggtgggaccgaacatgcggctgctgcgcacgccttcccatttgtcggcaggctggggcggcatgaagcgctctgccttggcgtagggaatacctttatatatatagataccgtcttgcaggaatcctcccactttgcccgattcggtctgggcgacggcggtctcggaagaggcgatgatttcgcccgtggcttgttgcgcgccggcggtcttcacgcccgctgtctgtccgcaagaggatagaatcagcagggaggccaacgcaagcatggataaaggttgtcttttcatggttatatctcgtttttttaagttgataatttgtctttgacttgctttcagcgaacgagttgacaagttgttcacttgttcactttttccggttgcaatattacgccgattgcgccggagggactggccgacatgtaaaaacgatttgcccggaggtttaaaagcgcttgcccataggttcaaatgtttgcctttttgttcaaaacatgctgcaaagcaacttatattcaattttttatccttattttcgcacatcattcaaaaccttttaatatgaccttgtctaaccggaaaatcctccgcaccctgttccgcctgctggccggaattctgtatgccgtctgcctgtcggcatgcgatgccaaagagcctttacccgaaaaccgggatgccgaaatcgaaagccccgtcatagccaacgacctctccaaccagaaagtcaccgccatagccgaagacacgcaaggccatatatggataggcacgttccgcgggctgaacaagaacaacgtgcacgactaccaccagtacttctgcaccgacgactcgctgggactgcccgacaaccagattacccacctgctgcgcgactcgaagaaccgcttctgggtgggcaccgtgaacggcgtgtgcctatacaccgacaaggacaacttccgcatcatccccatcgaggccgacaacaagaacgtgaggcagattctggaagaccgcaacgggcgcatcttcctcagcaccggcttccagctctacgcctaccacccccgggaggaaaagattacctgcgtgctgcccgaaatctgcaccggaaataccttctacgcacagtgccacatcgcccccgacaacaacctctgggtaatgacctccaccgggctccgctgctacgacctatctaccctgcagctgaaagagtctgtcgccctcagcggctatccctactactcgtacctgcacaacaacgagctgtggataaccggcaaccacaccctcagcatcttcgacacccgcacgcgcagcttcaagccgctgccgcagcccatcgcccagaacaccacactgtgcaacgccgacatcgactacatacacccctacggcaacaacggcctgctgctgaacaccgccagacacggcatgttctactacaacccagccaccggcagcgtgacccgccaagacgagaacggattccccttcgagatgccccgcttccgaatcagccggatgttcaccgactcgcagcagaacctgtggataggctccgtggaccaggggtacaccgtgtgctaccactacaaggagcggttcaacaacgacaactacctgcgctccgagctgaacaacaagtccgtggtgtcgctaagcgccggcaaggaccacaagctgtggatttccaccctgatggacggcatctacgtatatgacacgaagagcagcgaaatcaggcacatcgaccccgaaacgttctgcgagcaagagaaacagaaagccatctacgcgaaccagctgatggtggacagcgacaacaacctatggatgaccatcaccaacaatgaagtgctgaaagcccgctacacgcccgacgggcagctgaagatagaggaacggcaccggattttcctgcccatgtccatcgcccagtcgcccgacggaaccatctggataggcaccgccacggtcaacgtctatgccctgcgccccggcaagaaggaattcgaggcgatgaagctcttcgaggggttcaccttcgtgcccggcctggcgatgatggataaccgccggctgatggtgacgggcttctaccaacccatcaagcatatcgacatcgaaaacctggagacgggcacggcggacatctcggaagaggacctgaaagcctgcatacgccgctccgtattcgtccccacggccttgtacaaagacacgtacggcattctctggataggtaccgtaggcaacgggctgatgtgctaccatcccgaaacgggacggatgacacccatgcccggcacctcctgcctcgacatatcgggcatcgaggaagacctgcaaggcaacctctggataagcacccaatacggactgagcaaatatgaccggacagccggacgcttcaccaactattatgccgccgacggcataggcggaaaccagttctacgaccgcgcctcgtgccgtctgcccgacgggacgctggcattcggcggcacgcacgggctcacgctcttcaaccccatcgacgtgcccatcaagcgcaacatcccgctgctgttcagcgacctgaagatacacaacaagctgatacgtccgcaattgcacggagaaaccatcggcaagcacctctcctactgccccgacatacacctggagcacgaccagaacagtttcagcatctccttctctgccctgaactacagcgagtacggacgagtgcactaccaataccacctggagggtttcgacaactactgggtagacgcccgcaacaaccacgaggcctactacgccaacctgcctgccggagagtatgtgttccacgtgaaaatcaccaacaacgaccggagcatcgtggaggccgagaactccatccgcatccgcgtatatccggccccctggcgcacgtggtgggcctactgcatctacttcttgttggcaaccgccctcgcccttctcttcctgcgtgccctgctccgcgtccgcgccgaaaaggaggccgcccgccgcgcccgcctggagaaagagcaggagcaacgggtgaaccggatgaacatgagcttcttcgccaacgtctcgcacgagttccgcacaccgctcaccatgatttccggtcccgtgaaccagctctgcgccaatccgcggatagagggtgcggacaagaacctgctgcacatcgtgcaacgcagcgtgaaccgcatgctgaggctcgtcaaccagatgatggacttcaacaagctggagaacgacaccctgcgcctgcaagtgaagcgcgccgacctcatcgcctgcctgcaacgccaggtgggcatcttccgggtgaacgccgacgacaagggcatcgacctgaacacctacggactggaagacaccttcctgatgtggctggacgaggacaaggtggaaaagatattcaacaacctaatgtccaatgccctgaagttcacgccccaaggcggtaaaatcagtgtcggcttcgacgtaatagaccgtgagaaagccgcgcggctcttcggcctgtccgccgacgggcgcatcacgcagtacgtcaaagtgtccgtggccaacacgggacagagcatccccgaagacaagatagagaagatattcgaacgctattaccagataggcaaccaagccgaaggtacctacaactggggaacgggcatcggcctgtactacgcccgcagcctggccgtactgcaccacgggcaactgaaagccagccagtccgaagagggaagcggcgccgtgttcaccttcgtcctgcccgtgaacgacgccgcgtatgccgaagacgaacgggcaacggaacagagcaaccagtcggaagccttcccgctggccgccgcctcgcagcctgccgagaacaagaccggcaccgacgagaagcaacccaccctgctggtggtggacgacgacaccgaagtggcacactacctgcgcaccctcctctccgcccactacaaggtaatctgccgcttcaatgccgacgatgcgctgaaggcgctgcatgaggagtcacccgacctggttctgagtgacgtggtgatgcccggcaaggacggttaccagttctgccgggagataaaggaagacttgcagctctgccacctgcccgtgattctggttacggccaaagccaccgtggaaaaccaggtggaagggctggacacgggagccgacgcctacatgaccaagcctttcgaccctacctacctgctggcgctcgtcaagtcgttgctcaagaaccgcgagaaagcgtgcaccatgctgggaaaggccacgcagacggacaaaatagaagagaacatcctctccccacaagacaacgtcttcatgaccgaactctaccacctgatggagagcgagctctccaaccccgaactggacattgcccgcatgaccgaactgctgagaatatcacgcaccaagttctactataaagtaaaaggactgaccggcgaaagccccagcaccttcttcaagacctacaagctgaaccgtgccgccgaactgataacggaagggaaacataccgtctcggaaattgcggacatgacgggattcagcacgctgtcccacttctcgaagagcttcaagaagcagttcggagtaagtccgagcgaatacggcaaatagaaggacgggctacttggcttgttgtatgagggttatgcctttcaggagtgaaggtataaccctcatgcttttaacagccggcccttgtatgcacgagatgcacatctcacacaacacgagatgcacatctcgagatacatgagatgcacatctcgtgcatacaaggactacgccttaaagtgagagaggaatagccatgtgtgttaccgggcttccggaatattagtcgaatcatatacaatcatcgcccggccttcggccaacttcctcgcagtgggaggcatcttgatgaaatagttggaataaggttccgaaccttcctggtctccattcatcagcctgtgggaaatacgtatcatcgtctgaatataggccagcggcaaagaagatttcagataaggataatgtccgcaccagatatccttgatgtgcccttccttcatgagcttttccatacggcaacacgactcatggaaagtggcgatgggagacatcggcacacactgcagccatacttcacccgagccgaacgcatcacccgaataacagtctccgtttgccttgtccaggagtaccaccgagccgggcgtatgcccgggcatccatgccacttccagcttgcgtccacccaagtcgaacacttgtccttcttccatatagaggaattctccttgataatccgccgcatgctggggcaccagcaccgtatcggcccgatgcatccatactttatcgaaatacttgatgcagccggcatggtcggggtgcatgtgggtgacgattacttccagcggtttcccggttatctgtcccacaatcttatccaaatccgcacaacgcgtgccggtatcaatcagcacggccttgtcttcgccctctatcagatacatggtagtatagtcccaagtggaaaatacccaagtcttctctttcaacaaggaaacctctacctcttcattcttgaataccgtttgcgcccctatagccatacaaacaaacagcagggcaaatatcactaagtttcttttcatgtttttcttctttatatagttaaaccgaattgtgaatttctcaagataaatcaataaccgggattctgtttcaggttgctgttcacctccaattcattttcaggaaacggcagccactcgtcgcgattgggagtccaacccgccaacgacttttcattatcgacataggtggttttggtcgtataacgggcgttgtagatgcctgccgccgtagtgaggtcattattcgggtcaggtacaatctggaaagtcggtaactttttccctttatccgccaataccgccggagcatccccccaacgcttcaggtcctggaagcgcatgccttccatagcaagttccaagcggcgctccagctttatatcggaaagcgtcacatgactctttctgggaagacgggccctgtcgcgcactctgcccagatattcgtcggcaccggcttggtctcccgcctggaggcaagcctcggcagccatcagcaacacatccgcatatctgatgaccggagtattgctctggtttccacaccaataccctacaaattcgtcatcggtgcttgccagccatttcagacggaaatagccttcgctggcatatttgttggtagtcgtgttcaccgcaatgttcatggcaatcacctgctcccaggtcctgatccaggcattcaagcgatacccgtcggcaccctcctcagccacaaaggcatcgtacaaagacttcgacggattgaagtagctgtaaccgctggtagtgttgaacttatagtgcatggacgcttccggaccggctataaagccatagccgaatccccaattggccaagatgccgaaccagccctcctgagaatacatgttggaagggtcgtaatggcgcacacactccagcacatactccttgcagcctgcagaggccggatgatagaatgtgctgacatcggctatcaaatcatatttgccggaagaaatgaccttctccaactcacttttggcatcggcatatttctcctgatacagataaatctttcccaacaagcagcgggcagcctccaacgtggcgcgggttcccccgtccctgtcttccaaactcgttttcgaagtgagtttcccggaagttatagcttccgtaaggtctgtctccatgaatttccacaactgttcggcagtggagttgggcaccttatactcttccgaattcttcaataccctatctaccaaaggaggagtcccccacaaagtggtcaactcgaaatagcagatggctctgaagaatttggcctcggcaatgtttcttgccttcacttcactttcagcggcatcgaaccgctcaatcaccagattggccagataaatcgtggcatacaacctcttataatagttttccacccaaccgttcgtggccactatcgcactttcgtatatctcctgcgcatacacctggtcggagcgggcaccacccgaattgaaatcgtctgccaagaaatttttcaggaagaaaccgttggcatactgcgaggctttctcaccacgcccggaataagcattccgccaggacgcatagacagcagcgatggcagactcacactgttcatccgtctgataataattctcttcattctctacacctttctggggaatatccagcaaatcgacatcgcatgcggaaaatgtaagtgcacacgccaacagtccggacaagatatattttcttttcatatttcttctatttattatttaaaatgtaactgataaaccgaacaccaccttcttcgttgtgggataatttccgtaatccacgcccataccgctggtagccgtggaggaaacctccgggtcgagtcccggatacttggtgaacaagaagaaattatccaacgaggcatatactctcagcttgtcgaccaggaacttcttcgtaaccgtccggggcaacgtatatcccagctgtatctgcttgatgcggaaataagagccgtcaaaaatataagcatcggacaagccatacttgtctgcattcgtattctgcggccgtgcaaacttacggctggtagtcccgtccgccgtccagcgctggtcgtacatctccttcagcgtataggatatggagttataactgtaggacatgaatacgtcattgcccacggagccgttgccgaaaatcagaaaatcaaaattcttgtagttggcggtcaacgtgattccatatgtgaagtccggcatcggtttaccaatcatcgccttgtcactggcatcaatggtaccgtcacccgtattatccctgaatacgggattgcccttgtcatccagatgatcgacctgatagcctctgaaataccacaccggatagcctacctcgaatgcggagaacgaaccgttcgaagccattgtagtggcgccttctatgcgtccgccgctgacatgcggatccagataagtgacctcgttcttcaaagtggccagattggcggtcacagaatagttgaaatcaccggctttgtctttccatccggcctcaaactcaaaacccttattcgtcacattaccggcattcatcggagccgatgagtttcccgcctcataaggaatgacaatgttggaaacaatcaagtcttttgtcttcttctgataccagtccataccaaacgagaagcggtcgttgaaagcgcgcaaatccatacccaaatccagctgttcggaggtttcccacttcaagtcaggattatagagctgcgaaggtttggcagaagtgacatatttcatcgccgtattgctgaaagagtacccggcagccgaagtcaccagggaattggaatacttgtaaccgctcagattgcttgtgctgccattctgcccccagcttgcacgcaacttcaggaatgtgagaggggtattgttcttttccgtgaaaaagcgctcgttggaaatgacccaaccggctgataccgacgggaaatagccccagcgattggtacccggaagcacggaagtatcggctgcatcggcacgcatggccgcttgcagcatatagcggttctggtaatcgtaagccaaacggccgaaataggacagcttacgattaatcagattataaccggcggtactcttcacggcatctccggcaggatacgaaacgtcggcatacaaaggatcgtgcttggcagtcttgtctacaccggcagaaacataagtgaagttattctcgctgtaggacatacccagcatggcagacacatgatgcttgtcccacaaatccgtactataattcacaaagttctcccactgataataggtagtagaggagttggagcggctggccccgttcttatccttattattggcggaagccgaaccgtaatagagattgttatactgataagtgtttgcgttcagttccctgtaacccagccgggtagtaaacacaaatcctttgaaaggagtcaggttggcatagagcgttcccatcagactgttgccgaagtttttcttgtcgctcatgcggatggctaccataggatgtatctgttccatagaacccagacagctgtaataatcgcccttgtcattgcgcagcaaagtaaagccgttggcaatcaatgcctccatttgtttaggaagcgcatcggctgcatacgtgtccgcataataaggagccatggtcatcacggtagcaatcatactggaatatgaattgcccgcactaccgtcattgatggatttctgcgtatattttgcataattggcagtaacacctaccttcaaccaaggtttaatgttatagtcggcattcagcatgacggaaagccgcttgtaggtatccttgttttcacgaagaataccattgtcatacagattgtttaatgacaggaagaaagagcccttgtcattcgctccctgaaagttgaccgtatgatgggaggatggcgaagcattaaaagccacatcataccaatcggtagtcgatacaccgtcccatgtgccgctggtaataagctcctggatattatcatctgtaaaagtagggtcttgctccttcttttgcaataaagcttcttgtgaattaatcagcttgggacgttgcgccaggctactgatggaatattgaaagtcgtaggaaatgctgctggttcctttgcttccgctctttgtggtaataagcactacgccattaccggcctgcgcaccataaatggcagcggatgcggcatctttcaggacttccatgctttttatattattaggatccacagcactcaagtcggatactatcaatccgtctaccacatagaggggatcggaagtaccattcgatgaaaaaccacggacacgaatggtaggcgaagcacccggttgcgaagttgtggatatcagttgtacaccggctgtcttgccctgcagggcttcttccacccgggtaatagagcggttctggatgtcttctgccttcacggaagaaatggcgcctgtcaggtcgctcttcttctgtacaccatagcccaccactaccacttcatccagcgtccgggtgtcttctttcatcgttatattcattctctctgatacggctttcagttcttgtgtcacatatccgatgtacgaatagacaatgacggcaccttgctttacctttaaggaataatttccctccatattcgtaatcactccattagaggtgcccttttcaagtacactcacaccaatcatcggttctcccaaatcatctgtaatccgtcccgatatcatcatcggactttgcgccagcataaaaggtattcccacccaaaggaacagccagaatgccatcagctttcttttaaagttgttttccataatgcttaaataattagatttgttaataaaaaagctacattcacttattgtaggatttccgatacaattttatcaaaaaggagataagaggatattgagaaaatacaaaaacatttcctatatgttcagatattgtttcttgtacgttcaaaagattatcaatatgttcaaaacatgccatacagcatattccaagcgaaaaaatcactgttacagcaaatatcacctacttattttctttctacttttgtctgctccattgtaaaaaaacactctccgcggaacataccttaatacacttcatatatgaaaaaaatcattctttccctcatagctttatctgcaatagcggtgtcttcgtgccaaccgacaaccgccaaagcagaagcggaaaaacaggatgtttatagaatttcggcaaccatttccaaccaaaacattacggatttccaagaagacgcgcaaggctatatctggataggaaccacacgaggactgaacagattcaacgcacacgaataccggcaatattacagttccaacgactcactgcaactgcccggagatagaatccaggatattttcatggactcacgcaaacgcttatggatagcgacaaccaacggaacatgccgatataccgaccaagacaacttctgccagatacccataaacgtgccctataataataggaacggacatcagttcatagaaagcaaggatggaaaaatcttcctaaacatggtggtacatctctgcgtctataaccctgaaacagacactttcaaccgtattttcatcaactttgacccggacaagacctataaacagacctgctacatagataacaacaactgtctgtgggccgtcaaccccgtatccatccgatgctacgactcccgaaacatgcaactgacagactccatacccatgccgcagaagattacctactcttacatgcacaaccatacctccctatggctggcaagcaagaaccgactcttcatattcgataccgaaagcaaaagattcaaaacgactcccgaagcaataagtaatcatcccatcttatcgaaagccgccatcacctatatacacccgtacgacaagaacaggctactgatttgcacgcaaaagcatacgttcctttacaaccacatagaaaacaccgtcatacatgaaaaggaaaacggatttccatttgaagtcccgcaacatggcatcaaatgcatgtacaccgactcgcacaagaatctgtggataggctcgccggaccaaggctataccgtacgctatcattataaggagcgtttcaacagcaacaattatctgcgttcgttcttccatcaaaaatccatcatagccctcgatgccgactcctgcaacttgtatatatccaccctgaaagacggaatgtatatctacaacctgaataccaagcatatagaagctgtgaatatcagtagaatcctacctgcacaaaacacagaaaatataattgtcagacacatctatcacgacaaagaccggcacatctggcttgccaccaataccaatcaagtcataaaatgcgtgctcgagtctaatcaattaaaagcaacgagtattttttccgtcccttccgtactgtgcataacgcaagaccgtaacggaacaatatgggcaggcagcttcagccaggcaatatatgccctgaaaaaaggtgaaaaggtattcacacccgtatcactttatccccagtcatttttcacctttactcctaccctacgtcccctctccaatggagaagtatggattgcctcctttgccaacaagattcgttcaataaatccggatacatggaaaatccggataccggacatctcgagggcagacagcctggcctgcatacgccgttctaaatttatcccttccgtattatacgaagacagccaaggagatatctggattggaacctcccataacggtcttttacgatatacttcgcagaatcataaattatctcccatatccggcattggctgcacagagatttgcagcatcgaagaagatatgcaagggaacctatggatatccacattatacggattaagtaaatatgagcgccggaccaatcaaatcagcaactactatgcaagcgacggtatcggcggcaatcaattctacgaccgtgcatcctgccgactttcaaacggaaccttagtattcggcggcactcacggaatgacattcttcaatccggtggaaactcctttcaaatacgatgttcccctgacgttcgagaatctgaagattcataacaagcttgtatatcccggaaagaatgcaatcatcgacaaggacctctcctaccaaccggacgtatatctgaaacatagccagaccagcttcagcatatcatttgccgcattggattatagtgaatacgaacgaatacactatcactaccaattggaaggcattgaccgctactggataaatgcacacaccaaccgggaagcttattatgccaaccttcccacaggaacctatatgttcaaagtaaaaatcaccaatgaagaccaaagcataatcggagaagaaaaacagttgcgcatcatcgtcaaacctgctccttggaatacctggtgggcaagatgtgcatatgctctggtaatcatcggaatagccggtacacttatacacagttggcggcgcgtaagaattgaaaaagaaaccgcctgccgcgccgaacaagaaaaagcacaagagcagaaaatgaataagacatacatgagctattttaccaacatatcccatgagttccggacaccactgaccacgatgttgggttccatcagacaactgtgtgccgcccccggccaatacagtgccaaccgggaactactgaatgttctgcaagacggtattctgcggatgctccagttagtcaaccaattgctcgatttcaacaaattagacaacgacaatctgggactggaggtccaacagaccaaccttgcctccaccatcaaacgaatcatcagtttcttcaacatcaatgcccaaagcaagaatataacccttagcattcagggattacaccatgacatcctctattgggccgatgaagacaaagtagagaaaatactgagcaatctgctttccaatgccatgaagtttactcctacaggaggtgaaatagaaatctcgttcgccatcgtcacacgccaagaagccgaggagttcttctgcctgacagaacaagacaaaagcgtccggtatatccggatttccgtaaccaacaccggagaaaacattccggaagaacagctggaaaaaatctttgaacggttctatcagataaaaggcaacaaagggacttacaattggggaaccggcatcgggctttattatgctcgcagccttgcccggttgcaccacggatacctgaaagcagcaaaccggaaagaagggaacggagccatgtttatcctgattctgcccgcagacgatttctcgtacacaaaagaggaacggttctatggcaaaaaaaaactcatagacaatacttccatagaacctgcgaaaacagaaccggatgctacccatgaaggcaaaacaagtccaaaaacaatactgataatagacgatgacccggccatcatgcactatctgcagattctgctgaccccgcattatcacatcatcagccgactcaattccaccaatatcttccaaaccattacagatgaagccccagatttaatactgagcgatgtactgatgccggacaaagacggttaccagctttgcaaggagattaaagcaaacctacaattctgtcatatacccgtcattctggtaaccgccaaatccaccgtggaaaaccagatagaaggattgcataccggagctgacgcatacgtgcccaaaccttttgaaccggcttacttgctggccctgattgaatcactattgacgaaccgtgataaaatgcgcagtttcctgacgaacaatacccggacaagccggatgaaagaacttgcccttgccccaaaagacgaggctttcatggcagaactgtataaactaatggaaaatgaactggataaccccgaactggacatcacgcggatggccgaattactcaaaatctcccgtaccaaattttactacaaggtgaagggattaaccggcaagaatccaagtgtcttcttcaggacttataaactgaaccgcgcagccgaactaatcaaggaaggaacctataccatctccgaaatagcggacatgaccggtttcaatacccttccccacttctctacctgctttaaaaagcaattcggcataaatccgagtgagtatcaataaaccttgtatgtcccttaccagcacccacggctccctctaattcccttaaaagaaagagccgtggcctgtatagagattacttctgataaaagccgccaatcatcgcttgccataaaccagtttcttcgtccgcgggtcgcgggagaattgtttcatgaaatcccacatcaaccgtgcatcaggcttgaagttccaatgaccgtagtcattcacagccacgactttaatcagcggaatgtctcccttgtaaagcactcccgcttccatcgtgacgcgcttgttggtggaaatcacttccctgtccttcagtgccatgccgaaggtggcatctttcgaaaagtcaggccggctactcacctccatgccgttcatggtctgataggcagtccaggcacagaagaaggcattggtgcgccaattgttttcgtttacaaaaggcacgacttcgtcgtccgtacccgtcacagagaaataagcggtctccacactgccccgtttctgcaccgcctcgttcatcagggcttcgccactgtaaccgaacatataccggtcgggggtcagcccagccgattgggcacccacagcggcaaatacgtgcgacttgcgtataccaagtcccgtagccgtggcggctcctgccgaaagcccttcggcatatacccgcgaagggtctatctgcggataggtcttcaacagatgatacaccacctgctcgatgccgtccaaccccataggagcataaccgttgccctgccactccaattcggcaacaatgaagttctcctcaaccgccaactcaatgaagccggatgtctcagcctgtgtacgcggatcattgttgttgccatgcagcaaaagcaacaacggcacagaagccttttctgccttcaaagtagcttccggatggaattcataccataggaaatcgcctgtaccgataaggtctttcttcatcacacgacgagtgattccccaatcttcgggcatgatatacggctccagctcatacgtaccatattggtcgaattgagctcccgtgtaccaagtatgttcgtaattgttgaaacggtagttcttgcaaagcaaagtcttccaagcttccgcaaaagcttctttcagggaaatgtacttgtttgcactcaccacaacctgctgtagaggctcctgccggttggcataacaagccaacccgtcttctttccgcaccggttccgcctgattctgcaagatataggctgccgctacctgccgactgtgtgttccggcaataaaagcaggaacgggggcggcaccctcagccgtcttggccggtcggccattcagcgatacgataccggcaacagcacccgcatgtccggcaatggttctattaacgaacgtcgcccccttacctataccgattatcttcagattagtaaaaacacgcatcttgttcaggaaattcttataagcttccaaatccttcaccgcatcatactcctttcccaaggggttcatcacacagaccgtccccgaataggtgtgcgcataggacgcaatacccaattcatccgtcaacgccgccgcttcggaagcatcgcacggcttgtccggataaatcacgaaaaaaggggagaagccgggaaaacgtccctctacacttttgcacgtatcacgcgtaatgtaaacttcctgctccaacccaggaaaacgaacaaacggaggaagcccttcaggggttccaccagcccctttcatctgcaatgcaactacagaaaacaagagcccaaaaatgaaattcagtttcatagtatctttaacaatttgttttacgaccgcaatattagcgaattaccctcaaagcattctttcctatttgttcaaatgtttatcctccggttcaattttattcattacatttgcagtgtttcttaaaaccaaccgtatatggcacatcgtcttaataccaacaaacagtttatggtaggcaacggcatccttgcctttgccgtgattttcgtagtcgtcatctttgtctacatgagcatgaggctgcaacaacagaaagcggaaaaccgcaacttcatcgaaacctataccatcacactgacgaaaggctttgccggagactccacctccatcttcatcaacgacagcctgctggtgaaccgcaccatgacggaagaacctttcatcctcgaggtgaaacgctttgccgaacaaagcgcactgatgattgtgaacaatgcaaccgagaagctttccctgtttgagcttagcgaaaaaggaggagaataccggttcgagaaggaaggagaagaggtaaaacaactggcgcaggaataaaaaagctcagcaaggagtgttgtcagacgttatcaactttcattttattttttcttacatcaatataaagcaaatcatcatggtctgttatactatacagttccataaaatcctctgttaccaagtaatattcgtcaagcccctcacagtcgccgataaatatatgtatatcagacattcttgctttataaacgataaaatccctgttccaataatcaataaaaaaatagaaaacgatatttttgtcaattatatccaatagatgaaaataaggatcttccatgttacaatctatactatatggcacatatttaaatttcagccataatgcacgaggatttccaattacaaatgtgtcatataaccgttgtattaaaatctctttatcgacatctcctatttcctgaaatggaagatggttatctttgattgttcgttctatttctttataatcaaacatgacattttgcttctgttaataatctcgcattatccataccggtattaactttctgagatacctttcaaacgtgatagaagaggcagaccgctatatctccgttttgtatttccggagttctgttctcaatgcctgggcccttccatcagtcatccggtcgagcaaagcccagaaacgtttcccgtgattcatctcgcgggtatgcgccagttcgtgcagcaacacatagtctatcagatgtttgggaagaagtaccaggtaataggacagattgatattgccacgcgtggaacagcttccccaacgcccgctactggaattaatcttcacactcttgtaaggaaggttatgttgcatggaaagcatatacaggcggggaggaagaataatctttgcattccgtcgcaaagcctcctcaatcaccttacgtagccaagcctgcagattctcatccgagaaatccgcatccggcggacagattatctgcatttctcccaactcggaacgggacaagaaccgttcccgttgtccgccgaccaacgtcagcttgaagaactccgtatcaatgcggtaatccaaatcaatcagctttctgacctgcttctgtctggcagccctcaaacgcgaacgaagctgctcgatggcattctctacctcggcaagagaagtccggggaggcacggtcacgtgaattccatcctcctttgtacggaaagtgagacgccgtgcccgggcattgacccggacaaacaaaggacctagctctttatcttctataatgcggtttactgtcataaatcaaagcctctcccgtaggaaggggcggggaagaggctttgcaaatgaacaaagaatcgtccaaaaaagcaagcaaacacctgacaaaagcggacggagtgtccgataatgaacactatgtaaaagttattacactttagttatcagcgacttacacttgtggcacaataattgattaaagtatgatgaccgagcgtcctttgaaaaaagcatttctacatgcaactttttcaaggcaaatcacgtctaactaataaatactgaatcacaaaaaacaaaaaaatatgaaagctctaacaacatttatcgcaatcgccttattggcattcagtacaaccgcttgttcacaacaacacacataccgttccggaggcttcggcagcaagacggtcaaggcaagcaagaactatgtaaccaaagacataaaagtgaacaacttcaccaagctgagtgtagccggcagccccgacgtgacctacacgcagaagtccggcaaaccgacagtggaagtatacacctcggacaacattgtagacttactggatatccgtgtcaaggacaatactctctacatcggcttcaagaagaatgtcagcgtatcctacaataaactggaagtacgtgtgtccgcagaaaagttgaacggcattgccgtggcaggttcgggagacgtggaactgaaaaacggactgaagacggacaacctcaaaatttccgtagccggttcgggtgacatcagtggaaacaacatctcctgcatagacctcgatatttccatcgcaggctcgggagacatcaacagcagcgacatcacttgcaatgacctccaagtatccgttgcaggttcaggtgacatgaagctgaacaacgtaacggccaacttcaccaaagcatccgttgccggttcgggcaccgctatcctgagtggcagcacccaagaagctgaatacagtgtggcaggttcgggtgatttgtttgcttccgatttcgttgccaagaaagcatccgccagtgttgccggttcaggcgacatcaagtgccatgccacagatttcctgaaagtacgcaccagcggaagtggcagtgtaggctacaagggcaatccggaactggattatccgaagaaaggactgtataagctctaacattggaaaatatagactttaagattaataattataagcctaaactaaattctctctcaaataattacctataaagatgacgaaggactcccgcaaggaagtccttcgttttttgtacgccccacatctccgaagcacgggaacaactatcatttatctacattcagaatacccgactcattgtcgctgttattgatgcgtctgtcggatgatttgtaacgcttgccgaactcgaagttataactcagcttgataaccgccatctgtcctatctctttcgcatggctccacgaggtatagggtgccactttgcttacccgttccttacccgtcttgtagttgttggtgaacgggaacatcatccctacccccagctgcaggcgcttgtgggtataagtggccagaatggcagtctgattctcgcccttataaatcgtttcgcccatcagttcgttcgcccttttactgaattgtcccaacagagagaactgcttataattgaacacggcaaccagattgtaatagaagtcattatacgtatgggtataggtattgccgttagaccagtaacgtgtaaatccaccatctatactcagcgtcaggaaattcttcagactaccaatgttcagtccgcggaatgtgaaagaagggccaaagcgcagaaactgtgcagaacgctggttctcgctcatcgaaaccaacttgtctccctcggcaaacacactctccatgatgatattcttgtgatagccatgtgtcacattcagcatgaagacgaacttctgcttcatataggagtagttcaacgtattgttaaagacactgtaagtctccaatgccggattgccgcgtactatctggatggtatctatcgcctgctccacattggtcaacgcactgagcgaaggaatcttgggttcgacattgaaccgatagttgatgttgccgttcttgtgcggcgagaagttcagacggacagtgggggtaaaggtgtaataggtatgttcctcccctccttccttgaaataagagcgggtcaatccggcactcacaccataactcactttcttgatatttccctgcacctcggcaaacgccgctgtctttgcctggttcatttccgaaacgacgggtgaggagcctgcatactcgttcctggcatacatccggtagtgccgcaatccggaactgaatacgagggacttgaaacgcttgtcgtagatggcttcaccgatgatggaacgcttgtttcccgtcacatcggtttcaagcatcgccaggtcttcggcttgaggagtatattcgtggtagagcctgttattgtcggtgtgcatcagcgtaccggtcacgctcatcgtaagcatctgattcttcggtaatgtacgctggtaataaaggtcgagcgaaggagtgtagccggactgcttgttcttcagtccggagaagatatagttatcggcatccgcagcatcatacagcttgttcgactggttcagagagggagcatcatagatactgttgcggaacacgacgttgaatacgtacttatcctgctccgtcagattgtaagagaggtcgatattgtgggtaaagtgcttgttttggtcgtgaagcccctcctgcacacgatgtatcgtcttattttccaacacatatgtctcatctatatccgtatacgttttcttgaagttacgggcagacaagttatagaacaatccccattgtgactttttatgattgaacttggccaccacattgtcctcgctaaacaatatgtggggagcattagtggcttgtatattgaccagtccgcccgtttcgcggcggcggacaatgatgtctaccacagcccccaggctgctgtcgccatagcgctctcccggattttcaatgaattctattcttacaatctccttgggcaggagggctgccacttcggtggaggtagccacaataccgttgatacgtgtctgtacactaccgccattggcttccaggcctttgccaagagcatccaccttcaagtgcggaatggcaaggttcagcatcaggtcgtagggattgtaggaattcttcatggcagtggcggtaggtactacaaccatgcggtccactttctgcgtgatattgctgcccgatatcaccacctcgtccagcgctaccgactgttctttcaagatgatatcccccatctctacagtgccttgggggttcttgatgacaatctgctcgtcgatataaccgatgtaggagaatttcagcaggaaatctgaaccggtggcggttttcagaatgaatttaccttttccattcgtagtgcttcccgtaacgaatgaagagtcgggtaaggaaatcagggctacattgacaaattccaccggccggttctgctcgtctattaccgtaccgttcactttcactgtttgcgccgctgcggcaaagctacccaataggtatatgatagctataacaagaatctttttcataaatgtcggcgtttagagtttgtcttttaaagctgactcgatgattgcctttatctcttctgacgaaagagtttctttattggtccactccttgtctctctcctccgagatatccaatacggaatcgcaatgttccgacatcagcagaaagagcattttctctgaagtttcgcccgacgcgcttattacctcatagtgcacttcggcatacttgcaaaatttgccgtctacgttacgaccacatttacgctccaggtatccgtaacggaatttctcaccttcgcctaactgcgacttaacatattccttagttgccgactttattttatactggtcgcttccggggaagtaacatgaagtaagagatacaagtgcgaaacacgctgcgattgccattgttctgaatgtacttttcataagactttctgttttttgatttgatgcaaagttaaggcaagaagtctcttaactcctactaaatcgcactattaaaagtcttaatacttagcacataaagcactgattatcaacaatgacacattataaaagtcttaatccggcctcttccggtctaaatgcctcttatgcactccacaatatcctgtttttcgcctgcatttatcttctttcggatggaagtcttacgcacgtagatggttgcacttgtctgttgggtgaccacaccgatttctttcgtggagaaaccggcacagagcagacagcatatctgcacttccttatcagacaatacctgtccgaacttttctatcatgcgggaataaaagccatcgtatagtttatcaattaccggataaaggtctgcccaggcaagaagtccttccaccggaatctccttattgccgatgcccgaaataagtttcagcaacgcctggttctgtgaggtaggcgtattggcaacaagccgtatgatacccagctgctgaagaagcagcttcttgaagaaagcaccgctattctcttcctgattgtccgataccttctgggcatcttccagcaggcgggtcagtgcatcaatacgttcctcggcttcggcaaggcgcttccgtctgttacggatataaaaggtaagggaaacaagtaccccgacaaacacaacaacaaccagcatcgaatacatccgtgtcttctgccgtttgattatcaactcatagttcaactgttgaagcttgttcctggtcaccagctgttgctctatcacgctattctggtccctcatctcattcctgacagaatcagcaaacctaccgaaagtgacaatgtccaaaggtgccccggaagtatagtccagaattgttttcaactgtgccagcgcactgcgtacagaaaagccctcggctctcttttcttcctgcttcaattcattgttccacgcttgctcccaatagtaacgggcagaatccaactgatgaaggttcaggaagttttcagcaaagattacctgcagaatgggatagttgtcggtcataggcatcagccgtctaacccggtgaagcagttcattggacttggtatattcatggctgttggcaagaaaagcggcataattcctcagatagtgacaggccgaagctgtatcggctgccgccaatgccatgtcaatactctgttccaggtaatccgaagaagaagggtggttggcaagcgccatattgagtcccaggtcatagagtatggagcaatgttcccggacagatagcttatcagcatattgcaatatcttttccatcaactctatcgcctgggagtggtcatttctcagataagctatctctgcctttccccgataaaaaagaagaagccagaaggtgtcttttcgggctatggcatagtccaagccattctcaatcgcttcatccatgcgttcctcctgcttcatccatttataataggaggcttcaagcaggtagccatcaagcatacgggaagagtctttccgctcacgatagtagtgtatcgcttcaggaagcagcgaatcttccgccaatgacatacccatacggtagcgggcctgcgcacagttccaaacgaactgcatccactccgcttctgaaaacccgacatccttttctatggaattaagcaacttcagcgcactgtccggacggctctgcaacaaagagtcggtctgcgccaaaagttttttgttgccatgacagtcattacagcctacaaagcacataatgcctaaaagcataatacagatgtatagtatgtttctcatcttctccattgtatatatttgcagtgagtaaagttgagaaaaaaaacggcagactccaaactatatatactgtaaataataactcccttaaataaaaagccttgtaacccacaggcaagaacaacaaagggacgctgcatcacgcggcgtcccttctattttagttagtttttataagattttgagagaattgaaacttcacagcctcaagttgttttaataaagcacactaactattattatgtttaaagcaaatgaaaatgttattttaaaagcaaatgaaaatatctattccttgatttccagctccttgttcacccggcgcaggctgtccatcacctgcttctcatgagacacgggcacatctcccgaaagagctaccgacggtgcggaaatctgtttaccgatagtatcggctgcggccacctcctctacatccgagaaaaatgaatgttgcatcacattccccatagaaaggaccactgccactactgcagcggctttgaacaacggcatgaaacgtgcggtcaatgtcatgcgctttgccttgaccaccggaacttccacttcggcaagcacccgggcatcaaaatcctcacccaaatgcacttcctgctgaagctgctgatatacgaacaagtccttgtagcgaagcaagtgtccgggaacatcgttaccgctaaagaaagcacgcaggcatgcttcctcttccaaagaagtttcgcactgccagtagcgttccaagagttgttctatatatttagagtccataaccttctatatcaataaacgtttgttttactttttgccgcgccctgaagaggttcacttttacctgctcctcggtcaagttcaggaccgctgctatttctttatagctcttaccttccacatccctaagctgcataatcaaccgctgtttttcgggaagcttgttcatcagccgatgtatcaacgccatccgttccttgttcaccagcttctcgtaagggcccgatgcatcggaggcctgctccatttcgggggtcagctccacggtacgggagtcttttcgctcgctacggtctatcgccagatttcttgccactgtcaggcaataggcttcgatagagccgaattgcgaccactcgtcacgcttgttccagacccttatcagcgtttcctgcacgacatcctctgcctctgccctatcgaacgtaattctcagggctaaccgaaagagcttgtccttcagcgggagaatgtcattgcgaaagctgagttcttgcatctctaataaattgacggttaagtattcagaaagttacagcctattgccgttttttttgaattattttcggatacgggttccactgttcccgttgatggctgatgctaaagtgattacgacttcggacacacccgcattcaacgcctcgaaagagttctccaattttggaatcatgccaccttgaatcactccatcggctacatattgcttaaattcctccggcgttatctgtggaatcacgctgtcatcatcgtcttcgctgcgcagcacacccttcttttcaaagcagaacaccaaagttacatcgaacaaacctgccaaagccttggcggtctctccggcaatagtgtcggcattcgtattcagcatgtgcccgtctccatcgtgtgtcaacggagccatcacgggaaccacacccttatgaatgaggtctgccaagaaagcatcattcacctgcttcacatcgcccacaaacccataatccacctccttcacgggacgctttaccgaacggattacatccatatcggctcccgtcaagcccagtgcattgacaccacgcgcctgcaagccggcaacgatattcttattcaccagtccgccatacaccatggtcaccaccttcagcgtttcggtatcagtgatgcggcggccattcaccattttactttcaatacccagttgggcagcgagcttcgtggccgagcgtccgcctccgtgtaccaagaccttgtagccttcgatggctgcaaagtcatccaataacttatagagggtggcttcctcttctacgatcttgccacccacctttattacagtcagtttctccattttattccaaataagtatatccgtacagtccggaacggtaattagacaagaattccttcccttcttccacagagatacgcccttccttgacggactgcgtcacccaagtttccagcgtacgtaccagttttttaggattatattgcacgtaatccaacacctcagccaccgtctcgccgtcaatcagttggtcgatggtgtagcctttggaattgacagacacatgcacggcattcgtatcaccaaacagattgtgcatatctcccagaatctcttgataagctccgaccagaaaaaccgccagatagtagtgttccttgtcgcgcaacgagtgcaacggcagggtggtcgtatcggcacgcgagctgacgaaattggcaatcttgccgtccgagtcgcaagtcatgtcctgcaaggtagcctcacggtcgggtctttcatccagccgctgtatgggcatgatggggaacatctggtcgatagcccaggaatcgggcaatgactggaacagcgagaagttacagaaatacttgtcggcaagcagcttgctcaacttgcggaattcctcggggcagtgcttcatgccgctggcaatggagttgatttcgcggcagatactccagtagagtttctctatttgtgcacgcgtattcaggtcgacgatgccatggctgaaaaggtcgagtgcctcttcgcgtatctgctgcgcatcgtgccaaggttccagcatactgcgctggctcagattatcccagatgtcatacagttccttcaccagttcgtgagcatcctctcccggttcccagtcgtcgtccatttcgggcagggaagccgtttccagcacttcgaagataagcacggagtgatgggcagtcaggctacgtcccgtttcggtaatgatattgggatgagggaacccgtgtttgtcggcaacatcaacgaaagtcgacaccacatcgttgacatattcctggatggaatagttgacggagctttcgctacttgaagagcgtgtaccgtcataatcaactcccataccgccaccggtatccacgaattcgatgttgaagcccatcttgttcagctgcacaaagaattgcgaagcttcacgcaaagcattcttgatgcggcgtatcttggttatctgactgccgatatggaaatgtatcagcttcagacagtccttcatatcttttttctccaagaagtccagcgcttcgagcagttcactggatgtcagtccgaacttgctggcatctcctccgctttcttcccatttgccacttccactggaagccaatttaatgcgaatgccgatattaggtttcaccttcaattgcttcgccatcttggcaataagattcaactcattaagtttctctacaacaagaaaaatgcgtttgcccattttctgtgccaacagtgccagttcaatgaagctctcgtccttatatccgttacaaaccacgagggaacccgggtctgtattgacccctatcacagcatgcaactccggctttgaacccgcttccagccccagattgaacttcttcccatggttaatcatctcttctaccacgggacgcatctgattcactttaatgggatagataataaagttctctcctttatacccgtactcgtcggctgcctgtctgaagcagcaggacaccttctcgatgcggttgtccagaatatcgggaaaacgcaccaataccggagccgctacatcgcgcaactgcaactcgtccaccaactcttttaaatcgacggcaaccccatccttacgcggtgtcaccacaacatgacctttgtcattgataccaaagtacgaagtgccccaaccagttacgttgtacagctcttctgaatcttcaatacgccattttctcatcagtacatttactattagactatttacaatttactattttcccactatagtgtgtcttataaagggggcgacaaaaatacacataaatctaatatatccagctcctcggactgaaaaatacacatttacaagggattaaagtcctaaaagttggcgtaaccgttgcacggattcgctaatctggctgcggctttccagataaccggcatcaaagcgataacgggcctgcgagtagaaaggctcacgcttatccagcgcctccacaatgaaggtgcgcaaatcttcgtccgtcttgccttgcaggatggggcgttgctgcttcgccacccggagccggcggaacagaatatcggggtgtacatccagaaacaccgtctgcccgcaaccgttcatatactccatattgtcaaaaaaacaaggagtaccgccaccggtagagaccacgacatcctcaaattcccctacttcatgcagcatgtttcgctccaattcacgaaaagaggcttctccccgctcggtgaacaattcacggattgatttgtgaaaacgttcttcgatgtaccagtccaaatcaatgaacggcacattcatttcgcgggcaaaagcctttcctaaagtagttttaccggctcccatgtagccggtcaagaaaatacgtatcatatctgctacgagttacaggtttcctgcaaaggtagcaattccaagctgaaaacgcctctgtatcagagaaaaattttgatacgcttgcttaaatcttcgaattccttttctcccggttcaccagtgggtgtaccgaagggcatctgtgcaatcatcatccagttgtcgggcaggttccaggtgcgacgtacctcgtcgtcaatcaaggggttatagtgttgcagggaggcgcccaaccccatatcttccagcatagtccagatggcaaactggtgcatagcggaggtgtgctgtgaccaagtggggaaattatccttataggaagggaatgtttcctgcagcttcttgactacagaagtatcttcaaaatagagcacagtaccgtgtccgctggcaaaacagccgtcaatcttggcttccgtcttggcaaaagcctcggcagagatgcgtgctttcagggtttccttcacgatgttccacaattttttatgttcgtcgcccagcaacaatacaattcttgtagactgtgaattgaaagctgacggcacattctttacggcttcacgaataatgtgtactatttcttcatccagtactggcgaatcgctgccgatagagtaataactacggcgatgcgccatggcttctgcaaatgttctcttcattttttgtcctttctttttttattgagttttctcttatttattttatatccgccatacaaagaaacaaatgaaagagttaagttgttcggattttcttttttacctttgtccgcagttatgaagaaagaaaaatattacgtcgtatgggcgggagtcagcccgggtatctacacttcctggacagactgccaactacagaccaaaggctacgaaggagcaaaatacaagtcgttcgaatcacgcgaggaagcggaaaaagcctttgcctcttcgccgtacgcgtacatcaagcggtcggccccttctcctgccaagactattcccggcgccgacgctccccttcctgccgccgtcgcagaaaacagccttgccgtagacgccgcctgcagcggaaatcccggtgccatggagtaccggggagtacacgtcgccagccgtcaggaaatctttcacttcgggccgatgtatggaaccaacaatatcggcgaattcctcgccattgtccacggacttgccttgttgaaacagaaaggtttcgacatgcccatctacagtgacagcgtgaacgccatcaactggataaaacagaaaaaatgcaaaaccaaactgccgcgcgacgccaagaccgaagagcttttctgcctaatagaacgtgcggagaagtggttgcgcgaaaacacctacaccacccgcatcctaaaatgggagacaaagcaatggggggaaattccggccgacttcggaaggaagtaaaaaaacgcgggcaccccggattcttcatccggttgtgcccgcgtcaagaaaatgatgcggccgagcttatgaatgaatagccgccatcatgttttatttgctatacgatgccttcacgaaaggagcatcaagcaagtagtcaagactctgcttcacactctcttctacggggcagctgtatttctcaatctcagctacgatgtggcgcacgccagcagtatccgtattcttgaagatagcatcataacctaccataccactctgcccaatctcgcggtgatccttgatatggagcatggtgaagcgtccgggatacttgttgaagtaatccaccgggctgttctggccgcgcactacccagtaaacgtccatctggaagaatacatattcgggattggtgtgttgcagcatgtagtccagcatcagctccttgtcttccactttctggaattcatgggcatgattgtggtaaccgtatttcaaaccggcagcctggcagtgcttgcccacttcattgtaatagtcgcagtaggtctgcaagtctttcaatgtcttgggaacggagagatacggagtcacgatatactccataccggcctccttatgggcagcaatgcactgatcccaccatttcaaggcttccgtaaagtcgcccgaagccagttcctcgtccgacaacccgtgggtagtgtgcgaagaaagcacggtcataccgctcttttccaccatctgtttgaactcctggggagtcttgccgtagaacttaccgtcattgtagttggcggcctccacactggtatagcccatatcagccaaatccttcagaatctggtcgaggttactgccgtccttcaccaagtctcttacagaatagagctggatggctacttcctttttcgtcgtttccggcgccgtttccgtgctgtggctgctgcagcttgtggccatcatggataagcacagtgctgacaaaatcatcatatgtttgattctcatagtactatctttttagaaggaattagtcgagaacctttacacggatgttgcggtaccaaacatcgtcgccatgatcctgcacaccgataaagccttcgtggttttcgccgccacagttattcaacagttcgaaagccaagggccacttctcttcgctgaacttgcttgcctgcaacatttcagtccattgcttagtccacaagtgatattccagtacgttttcatcgttctgtccgtgaactacagtacctttgtataccataatctttgccttgttccattcgccgaaaggtttggcgttctgcggaacagccggtatcatgtcgtacaaggaagcagcctgacggttgttgtccttacccagtttggcatccggatgattggcgttatccagcacctggaactcgggagcagagatatagatgggttccaacacttcgttgccgtccttgtcctttgaagtaacttcctgagccagatagaagataccggagttaccacctttggaaatcttccattccagttccagctcaaagttcttgaacttatgggcgaaaatcaagtcaccgccttcaccggtctgtccttcgccggtaccggttccacagaatttgaggcaaccatcctcaataatccatctggaaggcactttgtccttaccgtatccacgccatccgtccaagctctttccatcaaagatagtgatataaccgtccgcatcaatcggcaggttcaagctgtccgtttcaggcgctttcagagacttggaataagacaacgcagtagtagtaggagccgcagcttcctccgtagcgttcgatttttttgcaccgccgccacaagaagcgagtataccgccaataaggcagcaagccaaaggataatatattttcttcataatctgaaaaattaaatgattagtattcgtttatgagcatcggaacctggttccgatactctttttaatgtttatctgggcatatcgggcaacttccagccttcgcggtagttatgcttgatgagctcttctgcaaaagctttggcatttaccggatctgtccatgtcttgtcgaagcttggatggccgttgtgtatcttgaagccgtccttgatgactgtacgcaatgtctcgtcgtcgccaatattggtaaagcgcatgttggctccgtcccattccagtgtcttgttcaggccctgcagacggatagccaatacacccattgccaccatttcattcatcggtcctgcttcggagaagtcagacttaggcattacgcggctggaaggactttccttacaagcacgtacccagtccatctcatgaccgccattcatagccttcggtacacggcggcaaaccttcggtgcattgggcacacgaccagaaagtaaccacgggttctgtccgtagcaaccgcaaatcagcgtatccttcgttccgtggaagatagtcagaccgccaccgctctgcatcagttgctttccttcggggaagcctttcggacggtcgggcatcatgccgccatcataccagtgaacttccacttcgggcatagccaccttcggcatattttcacgtgcggggaaagtcagcttcacgtgctgtgcttgcggagcgcaggcattgagcaacaatgtagacgaaccttctaccttggtaggatacaacaacttcaaagctctgaacggctggtgcaggatgtgacaagccatatcgcccaaagcacccgtaccataatcccaccatccgcgccagttccagggatgatagatttcgttatacggattcatcttggcaggaccggtgaacaaatcccagttcagagttttgggaatgcggtcttccttctcgggaacattcaatccttgcggccagatgggacggtcggtagcacattccacctttgtcacgtcaccgatttcgccgttccatatccactcgcacaccaagtcggtaccttcgtccgaagaaccctggttacccatctgagtaactactcccgtagaagcggccaggcgagtaagcagacgggactcgtatacggagtgcgtcaacggtttctggcaatatacatgtttgcccatcgtcatggcatcagcagtgatgatggcatgtgtatggtcggccgtagcgatgataacggcatcgatgtccttgcccatctcatcgtacatcttacgataatcccaatacttcttcgcattgggaagctcatcgaacacacctttcgcgtagcgccagtctacgtcacacagcgccacgatattttccgtagccttcacatgattaatgttagtgtgtcccataccaccgatacctacggcagcaatgttcaaacggtcactgggaggtacgtgtccgtgactcttacccaaaatgctgcttggagcaatggtaagacccgccaaagctaaacctccggtcttaagaaactctcttcttgtaaatttcgacatggttctttagattttaaaatcggttaatataattaagttttaaaacacttcttattacaataggcatcagactaccgtcttcttcggacggagcagtccgtaaccttccttcatatgcctccggcgctccctgatttccgccagcgtctgcaagtcgcctatgccgggcaggtcgtggcggcgcgcatcctccaggaaggtccatccgtattgggaagcaatggccgagtctcgcatctgcggcaatctcggatcgcgtttcccgctctcgatggagtctgccataatgttgcagagcttgtccaggttctttccgccaaacggtttctccaggcgaagcgtacggttcacgccgtgaagttccactacggcagtccggaaatcatgcgtcatgcgcacgataccttttgtaccgataatgtccgtatatgcattatgagtctggtttctggagagttgtccgtagacgaagccttgtgtgacatcgaaggcgatgccgttctcgaacgtaccgtggcactgtacccaccaagggtccttgtagtcccacatccgcatgccttgggcatgccaggtcttgtattcactgtcggcataccagcgggcgatgtctatgtagtgcatgccgcagtcgtggtaggcgggaccctcatattcgtgtccctcgcccggcgccaatcccggagtcatgtggcagatgcgcaagatagccagttcaccaatctcgccttcatcgataaactgcttcatagcctggtgataccaggagttccgcagataaaggttgacagcggcaatgcgatcatacttttcaatcaggtccacaatttcccattccttatcaatggtatcggcaatgggtttctccgtcaggatatgcttattgctccggacagctttctctatttgttcttttctggaatttgccaatgcaaaaagaccaacagcttctacactctggtcatcaaagatttcttgttcatcggatatgattctggatgaaggggaaaggtttcttgccaattctcgggaggccggatcggtatcgcagatatatgcgatgtcccatcgaccgcttttctgcatttcctcccaatacatttgccccattctgccgaaccctatcaaaccaacttttattttcatggtaggcgaatattaaatatttacagttatagtattatcggggtcgattgaattacatgattaagagtacttggactgatagtcatagtagctgtcgtcgtagacgttggatataattttttcatgatatttgcaatgtttatgtatatgttctttgcaaaaataggataattagtgatagaatggaagcaagcagatattaaaaaagcgtaaaagacaaaagaacgccctttattcatcatcgcctaacagccgtgaaacactctgccggcagccgtcaacacccacctgcatcatagattctgcgtaagaaatatagaagagaaagaagaattaataggctgtttgcaggaaattaacttcctatttagtcataacagcctagcacaagcgggtggaagcaaagtacgcagaattttatttctatgagagagactgcatatcattcagtctcttataatagccgttcttctcgagaagttcctcgtgcttaccacgttccacgatttcaccttcatagagtacacaaatctcatccgcattcttgatggtggaaaggcggtgggcgatggcaatcgtggtacgggtcttcattagccgttccagagcctcctgcaccagtcgttcgctttcggtatcgagtgctgaagtggcctcatcgagtatcaggataggcggattcttcaagatggcacgggcaatactgatacgctggcgctgtccgccggaaagcttgccgccacggtcgccaatgttggtctgataaccgagttcggtctccatgatgaagtcgtgggcattggcaatctttgccgcttcgaccacctgctccatagttgcattttccacaccaaaggcaatgttgttgaagaaggtgtcattgaacagaatggcctcttggttcacgtttcctatcaacgcacgcaggtcgtggatgcgaaaattcttaatattcacaccgtcaattgtaatctcacctaactgcacatcgtgatagcgcggcagcaaatccaccaatgtcgacttgccggaaccggactggccgacaagtgcaatggtctgtcctttgggcaccatcagattgacgtgcttcaacacttcgcgcttgccgtcgtaactgaaggagaggtccttaaattcaatccggtcattcatcccgtgcagcggcaacgggtttaccggttccttaatgggattctcggctttcagtattttgtccacacgttccatggatgccagaccctttggaatgttgtatcctgcctttgcaaagtctttcaacggattgatgatactgtacagaatcaccatatagaagatgaacgttgatgcttccatggaagtgccgtcgcccagaataagcagaccaccgaaccacagtaccaatacaatgagcagcgtaccgaggaattcactcatcggatgtgccaacgactgacggatggctaccttgttggttgcatcacgcagctcgtcgctgcattgcttaaaacggtccaccatcttgtcttcggctatgaaagccttgattatacgcagtccaccaagcgtctcttccaattgcgacatggtatcactccatttcccttgggcttccaacgacttacgcttcagtttcttgccaacttttcccatcagccagcccatacccggcaataccaggacagtaaacagagtcagctgccagctggttacaatcagagtggaaaaataaagcagaatcaagatcggattcttgagcagcatatccagtgaactggtaatggagttctcaatttcgcctacgtcaccgctcatacgtgcaatgatgtcccctttcctttcttcagagaaaaagccgagcggcaagtgcatcactttggaatagaccatcacgcggatatcgcgtaccactcccgtacgaaggggaatcataatggcagaagagccgaaatagcaggaggtcttcagcatggtcatgaaagcaaggaagagccccatgaacagcaatgtcatctgtggcccgtgtgtctcaatcatctgggtgacgtagtaatagaaattattcaccgccacttccttgatgccttcgctcccccactccatgtactcgtacactttggtattctcccccgttttgaagaggatattgagaataggaatcaacaatgtgaatgaaaatacgttgaatatggcagacagtacattgagcacgattgcccaaccgatatatctcttgtaaggcgacacaaagcgtcgcatcagctgcagaaattccttcattgcttgtagttaagtgaattatgaggtcgcaaagatacaagaaaacgagggaatggaaaagggtttcaggttatttctgcctaaatgcccacattctctactttcttttgtgtccttgcatacttctccagcaccatgtacactcatacattgtcatcttaataatagccggctcatttattttccatctttactcctaacttccacacaattttcttcaaacttcaatatgcccaagcaattatatgagtaaataatgaaaaagatgtacctttgcacccgacttaactgagaactttgttcaccacatgagaaaagctattatcgcaaccctatctgtcctaatcgtacttctgttcattgcttgcaatacccgagtgaactataataagtacctaattgcaattgactcgctcatcgttcagcaaccggacactgccctatctatgctcgaagcattcccgacaaacagcctgcagacccaagctgacagtgcttattatggcctattaatgacagaagcaagagataagaactacattatccaaaccaatgattccctgatacaatcggccctgacctactacaacggcacaaacgacatagaaaagcgggcaagggcccattactattccggctgcgtctaccgggattcacagagaagaacagaatctatgactcaatacctcatagcaaagcccttggctgaaaaagcaggagaaagacgtctattaagtcttatctacctgaatataggttatctatactattcacaaaacctaaatacacaagccgattccagctatcaattggcacaacaaataggtattcagctaaaggactctgttcttcaagcagaagttctgtcacgacgaggagtcatctgtatggaaaaaggagaagaattctatcccgaagccgaaaaaatgatgttgaaggcactcgctatcgtccaaaaacagtccaacatacaattaaaagaaaatgtgttctcctcactatgccaactatacaactggatggaaaacggagagaaagctatagaattcgccaaacagaatcttggcgtacagaaagaccgcacaacatgctacaaagctttcgaactacttggaagcgcatattacctaatattgcaatatgattctgcccgctactacctacaaaaatcccttttcacaacagactatgccaccaaagccggggcttacatgtatctggcagacatagccaaagagcaaggagacttagctacttccttagagatggaacgcaactactctgcctatttggacagcatgcagaagtccagacagcccgatgccattgtctgcgcagaacaagggatgccaagcaacaagcaaaacataatcagcaaacacacccattatcgtatcataggtatatcaataatcatattaaccctcattgtagctgtaatcatcctatcctataagaaaagaaaacaaaagcccaataaccaaaccgaaaaagaaatgctgcataaggcaggacttgttctattcgaacaatctgaggtatacaacaagatgactctaatcatccgctctcataaagaaaaggcagaatcagaaataatgcatcaaggtgactggctacaactaattgcagaaaccaacaaatgttggaataatattgcccgggaactacaatcaaaatatcacctgacagaagacgaaatctacttatgttgtctgtacctgacaaacctcccgataagccatttttgccatatattgagctgcgaacgggatactatttacaaaaaggcagaccgcatattagaaaacaaaatgggatttgcacacaaagagatatctcttaaggaagctttaaaaaagaatctccaatcatcttgccaatcataacaatcattagcaagtacaacaattatacaatattatacgccattatacaccgaaattatacaatattatacacttatcctgccgtattaaaccgacctttgcggcatcaataatcaaaaaagtgtataatgatgaagaatctattgtctatcttaattgcgacattctttttaagcaatattgtgacatacgcacaaaaaaagaacaatccttttacagaaatcgccctaatccaagcaaaaagaaaaaatccgactagtaaaggagatacccctatatctcgtagtatcattcaaaccgccaacgcctacctatataataatacggtatgtgtcgacttcaacgaggtattacccaccgtcaccatcctcctcatcaatgaatcaaccggtgaaaccgtctattcagaaacatacgatgctccaacaaatatcagcatcaacctagatgaagaatcatgcggcaactactccattcaaatagagtccgatgaagcattcctatatggcagcttcacgctatagaaacatccaactgacaaggaagtgatatatatcaccaatttataaaacgaaccgattgaaaggactgaatacgcgttaaaccagtcctttcaaaaggcaaactaaattaatttccagaattatgaagaaaaaacattttctttttattcccatcattacaatgggaatattcgccattagctgcaccaacacttttgacgagcagtttgttcaagaagaccaacaaatgccaacaacgaagtcaatgggagatggtcaatatcaagtattaggctacggttatgatataaccggagaatatcttgccagacaatccataaaaaacgaagtattagatattgcaggtttctatgcgaaaaatccccaattatacaaagtggaatatgtaggtgaaatcaaagacaacttttatgctggagaagactacatgaactatgtaaaagacatcatcaataaaacgaattttagtggttcggttgctgcaaaaatcaatcctaaaaaagatggggcaaccagcacagacacctccaataaggaagtaccctatagcctttcagcaaatgtctcttttgacaaagaatcaagcaataagacttccattacgaccaaagagacctacattcgggtcgaccaaatcaagcaattagaacgctaccaactttatgctgaccccacagttttggccgactacctcactccatactttaagagcagactttctacagcctctcctgatgccattatagaagaattcggaacacatattcttatcgacttcaatgtaggtggacgcctttctatattctataagtcaactatcaccgacaatctaaaagtagagtctaaaaccaaaattgccaaaggaggcatcactggtgccattaaaacggttaacctctccttctccggaagttctactacaaccgaagtagaacaataccaaaggagaaatagtaactggtcatgcaacgtcaacatgtatggcggccagcacgatggtcatacaatcacaataacatccgacggagcaaccaaccacacattcaatcttagcggatggcagcagtctgttgacaaaacgcattgtgtattgacagaaattaatttcaataagacataccccatatacgaattcatcaaagaccctataaaaaaacagcaaattaaagacgctgcagaaaaatacatcaaaagcaaaattcgtccgattatagaggtaaaaccaatgtttcaaataaaaagtccacacacaaaagacaactggtgggttttttcacaagatgacgtaaactatataaatcaagtaagcggtgattatttaactgactttttaggatttgtattagtagaacctgcacccaatacaaaaccaatgcatcgcctgaaaagcatacataccaaagacacgtggtatgctttcagttacgctgatgttgaatatgctaaaaagaaatggaatgaacagtattatggaatagatggatatgtatatgctgacgagcaacccaatactgtaccactgcatcatctcaagagcacacacacaaaagacacttggtacaccaacagctatgcgaccgtagagtatgccaaagctaaatggggtgaacaatatttcggaattgacggatatataatcaaaccctaaccattctccaagacataacagaaacactatattaacgtgaattcgatatgaatcaaaagaggttttgaacgaagctgatggctgtgatggctgatagtacagctatatcgaattcacgtatagttaataatactactttattcatactgttttcaaaccaagcaccaaacaaggtccaaggaaagagcaaaccacaccggaagaaatcatgcggtcatgctccttaaccgagctttatgaattgagaccaaaaagggagcatctcaggatgcgtccaattatggcagccgaaagggagctggcatccatttgccctatatgaccatgccggaatttgctcaattgcaaatttcatagccaatttgtaagaaggacgtttcaaatgaacttctttatcatgagtattcaaaagcaaaaagacatcttcggggaaaaaagaattactgtctgccatgcacttatcaattatagctttgtaatgctctgtaactgctatcatcttactgattttccttaaagaaaagccaccattaccaacatgaaaccaacaatacttcattctgcgcagattcttaggatagaaaatactccagaagcaacgctggacaaaccagacgaaacgagtaggaaacctccaatattttctttggtgcggcatccacggcgcaccaatataatcataccccagtgaagcccaaaagaacaattcgtctttaaacgcataagcatccaattgataaacaagcatataagtatagctcgaaaaagttctataaaaagccacgtcaagcattaaacgattataagcttcaataccttggaaacatctgtctgggaaagatattaccttagggagtaaaaattgagattgtatattggaaatatccagattttcaggcttaataatcactatggagtaatcagacaaaatatccaagcactgtttcagcgacaccgcttccatctctgatagagcaggtaaataaataggcactactactacaatatcttttttatccatacactataactttgaagggcacaaaaatacacaatataaaagatataaaaatcatttcaatcacagaacttcaaaactttcctttacctttgcatcgtattacaatatatagacaagcatggagcagccctttatagtatatgattcacaaattttcgaccagcagaaattcggcggcatttctcgctatttctgtgaaatcatgtccaatttacagtttaattacgatattgcagtacgctatacagaaaatcattatctattgaatagtaaaatcaagagacacggtatctacatcccccatttgttctttaagtatcatcaacagaaactgtatcaaagcaacgccaaactaatcttaaagctgatgcagaaacacgctccatttgtctatcatccgacatattacaatcccctttttcttaagcaaataggcaataatccttttgtgataaccgtacacgacatgacctatgaaaaatatccagacttgtttcaagactccatatccattattcaacagaagaaagaaattatcacaaaagccaatcacattatagccattagcgaacataccaagaaagatatcatagaaacattaggcatatcccctcaaaaaatagacgttatctaccacggttgtagtctacaatccactataagcaagcctaatctacatcttccccaaagatacattttgtttgttggtgaccggacatcctacaaaaatttccaacgattagcagaagctttcagtataatccatcaaacagatgcacatctacatctaatatgtgcaggcaaaccgttttcaaaggctgaatcagaattaatatcacgtataggcatcgctccgcatacactgcaaatttcggtcaacgaccagcatctgaaagaattatacaaccgtgctctgctatttgtatatccatcttattatgaaggtttcggcatccctattttagaagcctacacttgcaactgccccgtagccttgagccaagcctcttgctttcctgaaattgccgaaaatgcagcggcatatttcgacccattctctgtttcttcgatggcagaagctatcaaaagtgtgatatacgacgaagctgaacgcaccagacttatacttgccggcaaagaaaggattaaactttactcttgggaaaaggcaacccgccaaaccgaacttgtctaccggaaagtagcaaaagcagtcttctgaccattcatttccgcatagagaaagcgttgttcaatttcagcaagaaggtcaggacaggctttaccctcttctggaaacggtgtgtcttgctcatctcacggaaaagttcaaacaaaggctgctttttcaggcaagcagccaactgcaaagagtcgagtatcatgggaggaaatattccctgcaggatatatttcttttcctcctcacaaagacttaaagagacagaactgatgccttgcatattaaagatacttatcaccctctcgacatgtctataagaacagctttcaagcactatcttcttcacaaagaattcccaatcagaaacaatcttaagcgtctccgtataaaggcacccctcaaataatgctctctttataaaagcagcaggatgtcccaaagagcgttccaaaaaatattcaaagctcaagacatccgggtatacaaacaaatcctcctttccatcgccgtgtacaaaaagcaaatccccgtaaacaatgtcttcgcccgacaaaaaaggatgaatgtcctccaatacagcaaagtcatgaagaaaatcacccgaattcaaaaaaagtaaatactctccagatgcctcccggatgcctttattcatggcattatatatgcccgaatctttttcagagcaccaataagcaattttatcctgattgttcacaatcaagtccttactgccatcagtgctgccaccatctatgacaatatattcaaagtcagaaaagcgctgtctgaaaacactgtccattgtcttggccagtccttcagcattgttatagttgatagttatgacagatagtttcatttgtgaaaaagtccttttatatattgacggaaaaatcttctataccatttatttctatgcgcctcgcgcttcttgcgcagataaagcagttcgcgaatgatgtgcaatgcactgcctccaaaaaaggaagcataaagggttctgtgttttgaatagatataaaactccgtttcattaaatacatcggcctgctttgccgcagttatcatagattgctccttgacacggtaataaaagagtggagagggtatctgatacacaagactattttcatctaacaacctgataaagaactcccaatcctcgtgtcctttccgcatattctcatcatagccgccaatggccatgcaatcactgcgcctaaaaaaagcagaacaaaaaatatgatttctctgaagcaactcctcatacccttcataacgcaaattccaaaccttattttttactccgaaaaaaactcctcgacaaaataccagtttcaggaatggattgtcctcgaatgcctccatcgccttttccatatactccggatgtataatgtcatctgcatccaacggcaatataaattctccctgagccaattctatacctttatttctcgcagaagacaatcctccgttttccttgaatacatatttaattcttgagtctttccgcgtatactccaatgccactttttctgtttcatcaggcgaaccgtcattcacaactatcgcttcccagcactgataagtctgagccaataaagagttcaaggcttcgggcaaataaatggcttgattataacaaggtacaataacagacaccatacccttttcatttaatgcgtccatacaatatgtttatattttatctaaattatttagcagatgacaataatcaatttacaaagttaagaatctttccctactaaatatctatatactcccgaaatacaatgcaacaaatgttctaaagaaaaaggataagacaaaaaagccatcaaaacttctttcttctcagggaaatcaactttaaaagatttttgcaagaaacgattaaagctcttttctctatatctttccatctcccttttagtaagacaaaggtcatctatctttatcggcaaaataacattccatttccgattatacatcctgaccgtatcttggcaccagttgcgattataattaccttccgagagatgttccacttgaacttccggtgagcaacaaacataattcctatatcgtttgcttacagctatctgtaaagagaaatcaacatcatagcaatgaaatccagtcagcatcttttcatcgaaaggatatgccttccatacctcttttcggacaaacattccgaaaccgtccactgctacaacttccgcaaaccactctccttgtaccacattgaacccagtgaatgccgtcacatttccttttttttgtaaataagaagtacaagcaaaacgacgatgctgcatccatcccgaatagcagtcgaacattattttagttcctgcaaaacctattactccacaactcggttccgccaacttctcagcaacaaccgtcccccaatcctgcgaatggaatttcacatcttcatggacgaaaaacaaataaggatagcgagcctgccgagcaccttcattataagcgcgagctatagaccagcacttctcccgattatctatagcgataatctcatgttccactccaatagtagcatgtatattttggctgatttcttgcaatcgttccggtgaaatagagcaaatgataattgacagcattcctatatcctcttttatataatgtacctttatttgaatttatcttttctatgagtaggaagaaaaggaatcacaaatgctaatatcctatttatacgttccagatagtaatgtactggcagaacccccattttccctcttgcctcaacatacagacgggcacggatgtccggtgaaaccggtagtttcgctataagtctataacactctcccctcaccaagcattttctataccagccaacgtctgtacaagaaaacatatacgacatcacatctatcgtattgaacattccttcccctgtatatttagacctgctggttactttattggtatgttgccggaagtaattcaatttccggcgtacctctacaactttcccctcctgtgccacttctacccagaactgccaatcacccgcacagcgaagttgctgaaaggacttatctagtttatcgtaaacctccctcttgaaaagcaccatactggcattatacacataattcctatataacagattatgttttacatattctttgccatcgaatgttttcacttctccggtttctttccaacggtcacggctcttacgtttcatcctttgtccctgtccatctatcagaatggaaccagtaaggcacattattgcacttggattcaactccaatgcggcaactgttgcctccaaaaaatgaatatcggcagtgtcatcactttctgcaatccaaacatactttcctttagcaaggcgaatgcccctatcccattgaagaaaagtattgcctgtattcttttcattcaacactaatgccgaaacttttggatgttctttataggcattcaaaatatcacaactattgtccgcagaacaatcatccagcagaatcaattcaaagttctgataggtttgattgaggatgctttcaatcctctctttcaaataaacaacatgattataattgggaagtattacactcaccataggagaattatccataaaatttatgcagatttcatactttataaaacaaaaaaataggccgacagattatctatcgcctaccataaccgcaaagtggccatcaacggatagcccacccgccatcgcaatttaaacttacgcaccagattccagggcttggttctggtcttaccttgaaaataccagatgtagttgtttacggcatccagtacccgtgaagaggactcaccgtccagatgggcttcatgcttgtgcacataagcacgcatccgctccatcagttctgccggacgggaaatggccttttcaatagctccttctacagcatccgtctcagtgacattcagcaaatgagctcctggcatggtgttgcaataagtcaccaccggtttgtccaacatcatcgcctcaacaatcacagacgaagcatcggacaacagtacatctgcactgtttagcagcttggcatcaacaagtccactctcgtggaaagtaatattggggcaggaagcagccagttccttgtatttcttgaggacttccatatccgagaatttcggatggaacgaaataatccaatcccagttcttctcgcgcaccagtctcttgatggtatcaaacagatgaggagcagaagttatattttttgtaaacgtagaagagtacaaaactaccggacgtgcattatgaggagtatgtacacgttccttcacgaaagtatccgccttgcaccagccagtttcgtataccttaaagaaaccgtatttcctctcaagctccttaaaaggaagagtgctcgtttctccttgtgtgcaatagacatcgaaccatccacgaacagaaaaatggtcatccttttcatcgccacgcttattgatggggtagccatggaaaagggaaactttcactcccgggaagaaatcataaatataattacccggtgcaaaaacagcaataggctgataatccatcacttcctgaacagattgaagccacctttcatcttgattcaacagaaccggacagtctggctcgataaaccatgcaacatcgtctcctctacgcctgatttcgtcctgaagcgggcgaagtataggataggaataggctaccgaaacgaaaaataaataatgcttcttcatacactcaaaatatcacggcaacgacacaatcgtcacctcaaattaccaatagaacaataaaatccagcccttagtttgtaacagttttgctttctttgctttaaacgtctgcaaagtaaatacaagaattctgcatatactgcatcaatccagaaaaaaaaatgacttttatcaattttcctccaaaagttgctgtttatgaagctttttcttctctaaaatatctatctttgcaccccaatattttaaaaatactattttatgagaagaaacctttttcattgctccgacagtcaacaaggggcaacagataaagtgactcttttgttcggaatcaccatttttttcaaattcctgctattcgatttcatctggagcataaccaccacattcgcttcattctctaccatcgaattttatgcaaccaaaataatagccaccctcgtacttctcgtcccctataagttcttccggctctggaaaacagagatagtcatcatgcttttgctggatatactactgattgtcaacctgatgtatttccgcacctactatactgccatcccacttaacagctatggactttctggaaacctcgccgatttcaccggaagcgtttacgactctttccgctggtacgacatcttcttccctctatctaccattgccagtatccccctttattggcattacaaaagaaataccgccggaagaacatcatacaagtattacggaggagctttgggaatcggtatcctgctgtttgccatcaccaccctggccaaaggaggattcaaggaagcatacaacaccgtccgccagaaagcctatctgtgtgcaagcaccacttccatgtatactgtcttcggaagcctatactatgacctcatcaaccagaagcaggaggccaccccacagatacagcaagagataaaggagtggctgagccagaaacccggacatcaccctttgaccggacgtatcggaatccgcaacaactgcatcgtcatcctggcagaatctttggaaagctgggtactcgaaagggaagtggaagggcaagagattactccatatctcaacaaactgctgcaagactccacctccttatacgctccccacgtactgacgcaagtgaaaggaggacgttccattgatgcacagctgttgctttgcgccggtatgctgcctatcaacagcggcacatacagcagccaatatcctgaccacacctacggaaccctgcaaaaagccatgcatcagcagaagaactcgcgcaactacctcctgaccattgataaagtatcgacctggaaccaaggcgtcatagcctacagtttcgggaccgacaccatcattgcttatcatgactttgaactgacagaagcctttggcacgcacaaacgtaccggagacggctccttcctggcgcaatgcagccaaaaaatagagaagggggaaatctggaagaagggggagaatgtttacatgcagctggtgacctactccggccatgctcccttcaaattgcctgaagaattgaaagagattcatttctctccggccattccacagaaaatgaatgactatatgaccactgcacgctatacggacaaggcgataggaaaattcgtggagtacttgaaaacactcccacaatacgacgagacccttatcgtcatcaccggtgaccacgaaggactggctacctaccgtgaagaattgtgtaacgcccccggtggcaagggtatcgtatccgacaagacattcacccctttcatcatagtaaactctccggtaggcatgcgttatgataaagtgatgggacaaatcgatatgtaccccaccttactgaacctgctccaactggatgattactactggagcggattgggccaaagcatcctcgacccatgcaagaaaggattcgccatcagcccccaaatggaggtggtaggtgaagagcccaccccggcagaagccgagttcgctaaaaaagcatacgatatttccgaccagatgatacattttgattatctttgctcaaaagcgaagataggcggcacctcaaaataaaaaatgaacaagttcattttgttctgctttcggtttgcactatctttgcaccgttcaaaagaagtaaaatgtaaataaaagcaatgaaggtacatattcatccgcactatgccgcctacgagagttatatccgagccatcccatcggaagaatatgaacgggaagaggtttattgtaaccgaaggaacacagtcgaaagagtgcggttcggagacaaggacttcgtaatcaagaaatacaaaagacctgccctcataaactgcctcatttacacttggttccgcaaaagcaaagcgcagcgcgcctttgaatatgcagaactttttctgcaacggggaatagagaccgcccctccggtagcttatatagaaatcaaaaagaatggtttcttccacaccggatactttatttccgaatacctcccctacccgcttgttacggatatgttcggtacggaaatggaggaagaagagaaaaaacggctaagacatgacctcgtagacttcactctccaattacatctgaacaaggtcttgccactggactataatcccaagaatatattttaccggaagacaaacggcaaatatcacttcgccctcattgacatcaaccgcctgaagctcggtaaagtacccggtatcagaatgtccatgaatgccttcagccaactgggtattcccgccgatgacttcatgaaaataatacctctatatgccgagcaaagaggattcgatattgaagaatgcatattcttcactctcttcagcagactgaaatggagaaagcaaagacaatttaaaaatttcgtcaaaagcaagcttcatttctgaaatgtcgtatctttgtaccaacgagattagaaaattatgcaagattatatcatccagtccatccaagaaggtatcaggctcaaagaaaatatcctgaacaaccggcaaatgcttgccgacatcgaaaacgtcggcaatctgatagtacaagcccttcgacaagggcacaaagtcttgctttgcggtaacggcggcagtgcagccgatgcccagcatatcgctgccgaactcgtcggacgtttcgtgaccgaacgggaaggcctgcccgccatcgccatgacaaccgacacttccatcctgaccgcagtcagcaatgactatggcttcgaacgcgtcttcgaacggcagacggcagccttgggaacgaaaggtgatattctgataggcctttccaccagcggcaactcccccaacgtagagtatgccttgcaaaaggcgcagtccatgggaatcatcaccgtgggacttctgggaaggaatggaggaaggtgcaaggaactttgcaattacccgctgattatacagcacaccgaatctgccaggattcaagaagtacacattaccatcggacatatcctgtgcggcatcgtcgacaataaactgttttctcatgaataaagcgattttccttgaccgggacggtaccatcaatgtcgatttcggctacgtttataagccccaagagctggaattgctgcccggcgtagccgaagcactccgcatctttcaggaactgggttatctgctgattgtcatcacgaaccaatccggcattggacgtggctatttcacaccggaggacgccgaactgttcaaccgggcactcgcccaagagctggagaaacatggagttatactgaacgatttctatacttgcccccacgctccggaggaacattgcgaatgccgcaagccttctcctttcatggtgatggaagcgatgaagaagtatgacatcgacccgtcccaatcctatatgttcggagacaagaagtcggatacggaatgcggcgagcgaagcggtgtcaagtctttccgggtcacagaggaacatccgcttatatactgggcaaaccaattaaaaaacaacctattatgaatacagaattaaacagtataaagggaaagaaggtactcgttatcggagacgtgatgctggatacttaccatataggggacgtgaaaaggatttctcccgaagcccccgtaccagtggtccgtgtcacccgtacctacaatgtattgggaggagcggccaatgttgcaagaaatctgttgggactgggttgctcgccgtatgtcgtcagcctgcttggcaatgaccacaacggaaacacaatgcaggagatgttcgctgatttgggtatcagaaacgaactgtttcatacagaacacccaaccatcaccaaaacccgcgtaataggcaacagccagcaagtagtacggctggactttgaaacagaaaatgaatgcctgaacgaagagactgagcagaaactgctggatgccgtgaagcgtgcactccccgaagtggacattgtcgtgatttcggattatggcaagggagtatgcaatgatacagtatgccagcaggttatatccgcctctgccgggcaagggaagaaggtcattatagaccccaaagggacaaattgggagaaataccgttccgcaaccatcatcacccccaacctgaaagagctttcggctgtttcgggagtggatgtgagaaatgaggataaagaaatccatagcgcagcagaccggatactgaaggagtataaccttacttctctattagtgacacgttccgaaaaaggcatgtcatacatagctcccgatgcctcgcaggacattcctaccgaagcaagggaagtatatgacgtttcaggtgcaggcgatactgtcgtggcaactttagcagctgcgctggcagccggtatccctattgcagatgccatttatcttgccaataaagcggccggcattgtagtcgggaaaataggcaccagccccattctgttcaaagaattgcaggacgagctacaaatcgggaaaccggccagcaaacttattcctatttcccaacttgcagatactataaaacaactgcgtgcgcaggagcgcaaaatcatattcacaaacggctgcttcgacattctgcacaaaggacacgtgtgctatctggaaaaggccaaaagactgggggacgtacttatcgtaggattgaattcggacagctcagtaaaacgtctgaaaggggaatcgcgccctatcaatgatgaaaacgcccgctccacagtcctggcagccttggaagcagtggactacgtagtgatttttacggaagatacccctctgaatctcatcaaaacagttgcaccggacgtgttggtaaaaggtggcgactatgccatagaaaacattgtaggcagggagtacgcccaagaaacagtaactatccctttcgtagacggttattccactacaaagactataggcgccatcaaccaagagaagcaataatcttttcagcgacttgttggggggtaatatccaccatacacttctgataaacagccagcttgcatttaccccgtccgtctttggtgcacggacggcaaggcagggctgtttcgagtatttccaccgtaggtcccgtagggaaaccgaaggccgtaggtcccatcaaggcaaaagcaggaacacggaacaaatcagcggcatgcataaaacccgtatcagcgctgattaccagattggaacgcaacactatgtaagaagactccatcaatgaggtttgtcccgcaaggttaactacccgttccggtgcagcacttctgatttcctcacagaaagtatccttcggaccagccagaataacaaatttatactcaggaagaagggcaaccaattctttccaataggaaacgggccagcgtttcatttcccagttggcagacggcaccagcgtaatcatatctttggttacaaagttctcatacttgctacgtatttcatccgggaaatgccagtcgtgatagttgtccggaaaatgcgtaattccccatttcttcaatggtttctgaaaagacaccatccccctgaaaggcttgtcgaaatggttgattcccagtttgaacaacaaaaagcgtttgcctctctctttgctccgcagagcaacgtaaggtttcacaaaaggcaatggagacactatcagcttcaatatgttggaacggatattactatgagcgtcataaatgtagtcgaaatgctcttttctcaaatcagccgccattttcaacaacccggcaagtccggtctccttgtcaaacgcccagattttatcaatcctgccatccatcgacaaggtccccaccatatctttccgggtaatccaatgaatttccacatctgcaaaccgttcacgtattccaccgataattcccatacactggataatatcccctatcgaactgaaacggataattaagaatttggtcataacaaatttattagaattgctgattcggcacaaaagtaataacttaattcaagtttcgcaaatagcgatataggctaatcatacaatatagaacatcagcctacacaaaacacaaacataaaaattcaatccaagtccaaactattgtctacaagaaatctagaggtattatatatcactcataaaacagtatatttcacaccaatattgtttttgcatattataaaatataaatgttttcaagtaattataatcaaaaactccatttatataaatatctttgtacttattttctcaattagcaaaagatgacagctataaaatctcaaaacagattattttcaatcgttatacctacatggaataaccttgctttcctaaaactatgcatacaaagtatccaaagaaactcttactacaatcaccaaatcattgtacacgtaaacgatggaagtgacggaaccttagagtggataaaaaaagcaggtattgattacacacattctgagcagaatatcggagtatgttttgctatgaatatgatgcgcactaaagtcaaaactgattatattctatttttgaatgatgatatgtatgtactccctttttgggacaaggttctctatgacgaaatagaaaaactgtctgacaattatttctttctttcagctacatcaatacaaccacatacacaaagcgcatcaaccatcttagccaattatggagacagtatcgaaacttttcaagaagataaattactgaaagaatacatgaactacaaaataaacgactggatgggagctaccattcctcccaatatcgtacaccgggacatttgggatttagtaggcggttatagtatagaatactcacccggaatgtacagcgacccagatttcaccgcaaaattatatatgtgtggagtcagattcatgaaagggctacaagccagtcgcatctatcattttgaaacaaaatcaactacccgcatacgcaagaattgtggtcaaatgcaatttctattaaaatggggcatgacttcatccacattccgcaaagttttcacttacaaaggaaaagatttcaaatcccaaaagataggaactttcaaaacaggaaatagattcaaaataagcctaatacgcggccgcctaaaagccatattttatttattaaccaaagatttcggtcccttatggaaattttggaaaaaaacatttgtctaacatttccctaaaagagcaaaattataaaatagaattggaactttcttgtgaagaatagggcttatccaaatccaaatagtggaaattatgctgtctctgcccgctttgtttcggtataaccatgtagtctccatattttcgggtcagataggcgtcataatcttgtactccccacactgtttcgccctcaaacgaaacgggagtcggagctcccagctctgccttgggcataataccgcgcataccgtcgtcataatcacagactaaagaagacttgtcaaagtcataggtggtcatcacatttctgatactcctctgtacgccggcagtagtaaaaagtctccggcacagcagcggcaaccatgagccgggaccttttccatgtttataagggtcgcggtagataaaatagagcacccgcttgtaaaattcataccgggcaaaatgaatcctctgtttcaggttgctttgcggtacaccgtccaatggaaatacgtccaagtagatacctcccaagtatttcaaatgcatacgctcgataagagtcgtatccgcatcttgtatcttggcaaaaggtaatggataattcggatcattttctgcgcagacagcctcataaggcttgggaagccattccttggaatgagacatcaacaaatcataatcagccctcggcataccgatatccaaatcatcgtcccaagggataaatcccttatgacggactgcaccaagcatagtaccggccattatataatagcgcaaaccatgttctttacaaactttatccacagcaagcaatatcttcaaaatacgaagctgcaaaggacgtatatcataatctgccataaaaatcagcccattaattaataaagttgtgaaggaatcaaccgctgtgcttgttcaaagtcattcaccgtatcaagctccacagaaaaatattcggtagtgtcaagcgcatagaaagagtgtccttgcggtatgagacgctcaaaagcacgttcatagaagatattatccaaaccttctttggtaatcataacctccaattcccggaaaagcgcttctgtataagcggcagacatcttctcgatgccaatagactcgccaatagctcgggatatggagcacgtcttactgatttccaacaccttgccatcattgtccgctattaccttgatttcctcttcccccaatgtatgatggttcagagccaacgcatccgcttgaccatatccaagcaacttggctacaatctgcgggtcaaaaaggatatcgctgtccagcaacagaatgtcctctttatctacataaggccgtgtaagccataaagagtagatattattggtagaagcatatttctcattatagataaacgtaacctccaatgccggataatgagcttccagaaagttcacaatctgctgctgtctataaccggtgacaatgacaaactcccgaaagccattctgcagcaatgcatcaaaggctctttgcagcaaacaacgctctccaactttcaacagacattttggagtggtatcagtcaacggacgcaaacgcgaagctatccctgcagccaatataaccgctttcattgtaatgcaatttttttaatggtgtcaatgacaatacggttctgttcaggacgccccaaggtaatacgcaaatgggtattgatgtctggttcattcatgaacttcaccttataatcctcgtcggcaaaagctttctgtaagcgttctttcaagacaatcggatattttataaggacaaagttcgccaccgactcatataccttgaaaccaggcaacgtccctatctccgcttcaaagcaggcgcgactctcattcatcagccgtgctatattccggtaatgcgcatccgatttcagtgcggcaatagcaatatcctcagagatacggttataacccagatatttgttgctgtatttgccaaagttggccaactccttactcataaacccaaaacccatgcgcaatccaggcaatccgtagaacttggaaagcgtgcgtgaaataatcaggttgggatatttatcaaccagcatcttaatatagtccgtatcagtagatacgaaagaggcataggcttcgtccaccaaaacgatggttgttacgggcaactcagccaacaaagcgtccagttctacaggggtcagaccgttaccggtgggattattgggcgaagcgattaataagaccttgggattctcacgctgtaccatctctttcatggcagcgaaatcatatttaaaggtattgccatcctcatacaacggatattgcagcgtacgcccgttcacctcgtcggctatggatttatagtaccaccacgagaatttaggaatgagcatcgtcttgttcccatcctcttgggtcaggaaatagtggactgcttgtttcaatatatcttctccaccataacccaacagtacctgcggttcatcgattccgtaagtctcggacagataaacggacagaatgctcttcttgccttcgtcgtagatacgggtatagaaacagagtttgtttatatcaaaattctttagagcctccaccacctcttgcgaaggtgcatagttaaactcatttcggtccaaataattcatatcttagatttcttttgttagtactttccgataacactccatcgtctcacgcgccatctgctcctgcgtgaaacgctgtgcccacttcagcccctcctcaatcatggtggcacgcaaagaaggctcttgtgtacgggcaatcgccgctgccaatccctccacatcgtggggactcacatacaatgaatgctccccccccgcttcttcaagacaagagccggttgctgctaccaccggaatgccggaatgcaaagcctcaagaatagggatgccaaaaccttcgtaaacggatgggtatacaaaagtctcggccgactgataaatggcaggtaaatcgtccgaagggataccatgcagaaaatgtactctgtcttgcaatccggcttttgtcataaactctttcagctgatggatataggctgtgggtctccctaccagaacaaaatgcagttcatcgggcagatactccaaagccttcacaatggccagcgcatttttacgctcctcaatggtgcccaccgacaagatatagcgttcgggcaaccgataactccgcatcacctccttgcgcttatccttaccgacacgacaggcatacagagaactacacccttggtaaataacggaaattttatccgcaggaattccataataatgtatgatgtcacgcttggtacactcactcacggcaatgatgtggtctgcatgcttgcatgcatagcggcatttgtagttataaatcaagcggtcgaccaacgaaaaacaatgtgaaagtctcaggaaaataaggtcgtgaacagtcaccacactctttacttcccgtacccgatggatggtcaagggaagttcgttactcagtccgtgaaacagccgtatgttgtcccgtttcaaagtcctgcgtatgcctcccacacgccacaacgaagtcattcctctccagagccaataagatggataatgtaccgataccgttccccggctttcagccaccatcgacgagagttgctgattttcacggtgtaccggagcatacagccaatactcgttttccggagcaaaggctgacaatgactgcaccacataccggctgtaattgcccaatcccgtaaaattctgcacagcccgttttccgtcgtatcctattctcatctctaaaaagtttcagctgcaaatgtacaagataatcctcatatagcagtctatttcgctttccttttttgacaaaaacacaaattcacctataaaacataaaataaagatgagcaatcacttgctgtctgttacaaaaaccaagtacggaatcgggcacatccccattgttcaatccgtactgacccattgttttatccttcaaacaccttatctccttcccgaaaactactttattcatcatcggcccactgttatgaaccaattcaaccacactagtgagctgtttagttcactcaagtgaacatcacggctcactaacgtgggctgctgaagaatccaaaagtaaaacgaaagaatgaaaaggatgcaacagaagaaagaaggatgcggaacggaagaaaacacgggtgagagcaaaatttaccctcacccttttcgattgctctcacccacccctgcaatgccgatgaatagggaagttgaagaaaagagtgagagcggtgagggcagaaatgcaaacttaaaaacggaaagagtcaaattattttccgggcattacttagccactttgacggattagtcgtatcttcgcacgatggaaaatcgtcgaaaagaacagcagcattatgagagtcattgttgacaacaaaatacctttcattaaagaagccatcgaaaaaatagccgacagcgtgatttatactcccggcagagacttcactccggagttggtaaaagatgccgatgcactgattatacgtacccgcacccgctgcaacaaggaattgctggaaggcagtaaagtccgcttcattgctaccgccaccataggcttcgaccatatagatacggaatattgccgtgaagcaggcatcgcttggaccaatgcccccggatgcaattcagcatccgtagctcaatacgtgcaatcagccttactattattgcaacaactcaaaggagtacaactgtccgaattgacattaggcatcatcggcgtaggcaatgtgggtagcaaaatagcccaagtagggcaagaactaggcatgcgtgtcctgaagaatgacctgccccggcaagacaaggaaggagagagcgatttcagttccttgcaagcactcgcagcagaatgtgatatcctcaccttccacgtacctttatataaggaagggccatacaaaacattccatttggcagaccatactttcttccggtcattaaaacgctgtcccgtcattatcaatacctcacgtggagaggtgattgaaaccaatgcgctcctgaatgccttagaagacggactgatttccgatgccatcattgatgtatgggagaacgagcctgatatcaatcttaccttattaaatagagtgttccttggaactccccatatagccggttattcagccgacggaaaagccaatgccacccgtatgtccctggatgccctttgccgtttctttcacatcaaagccgactaccgcatcgctcccccccaaccccggaacccgattattaccgccgacagcctggcagaagcatatctgcaaatgtatgacccgagaagggacagcgaagcactgaaaacacatcccgaacaatttgaaaaattgcggggagactacccgctacgaagagaaaaagatgcttacatttatatcccaaagtagcacatacatttagagatacagcccgataatacaaaagacgtcactatataagctcctcacgcctttactatcaatgccgaatcagaggaaactataggcaaaacattacaatatcaatacaaaaaatacggttagagaaatcactcagtgaaggatttattttttatgcaatttcaactctgacgattgccatacaatttctattttatctgattcacagtccccggctcgccatgatggacgtgggaggctggatgttttatataacggccgcttgctcacatgccgccttgtgggcacttattccttacatcatatccttaatcgtagccattaccgtccggcgccatcaagccgccgccatcacacacattattcttgtatcattactcaatatacttgcttacatagacggcagtgtgtacagtctttacaagttccatatcaatggttttgtactgaatctcctggttggagagggcaacagtgagattttcacattcagcttctggctttatctgaagattgcaggagtattagtgggtatatttgccgccaatactttgctaagaatacttgcaggccattgttatacccgctttcaccgctgtggcttccgtcctgtacttgccactctgattttgtttgcactattctctaacttttatcatgcctatgccgctgtagcgcaaaagacttcagtgattcgcagcgccccctgcctgccctattacttcccgcttacggcaacccgcctgatgatgaagttaggagtggtctcatccaaggatgtcattaaaatgaacttcaacaacaagaagcagtctgctgacctcaactatccgatagattctttgaaatacgaagtccattccaaccccaagaatgtagtgctgatagccatagactcatggaactaccgcgcctttaaccaggacattacacctcatatcagccactttgccgacagttgcagcagattcacctcccatctaagcagcagcaatggcacacgtggaagtatcttcgggcttttcttcagtctctcatccatctactggactgattttgaggtatcgggcatacagcccctgctcatagaagaactattgaagcagaattatcagataggtatttatcccagtgctacaatcgtcaacccgccatttgccaaaatacttttctcaaaggtacccgacttgcgtacccataccgaaggaaaaaccgtttatgaccgcgactgccgtattacagcagattatctgcaagcactcgatacgctgggcagcggtacaaaacctttcttttcctttctcttctatgatttggcacacggatatgaagtaccgaaggacaagctttatcgtttccaaccgtcctgggagttcgccgactatatgaaactgaacaacgacatagaccctactcctttcctgaacctctactacaactgcgtggcggaagccgactcactggtgggatgcgtcctccacaaacttgaggaaaagaaactgctagacaataccctggtcatcattaccggagaccatggacaagaattcaatgagaatcataaaaattattggggacacggcagtaattattcaccggtacaaacacatatccccttcctattatatgaaccgggagaacagccacatacctaccatcaccgtaccacgcactatgattttgcaccaaccctaatgaataaagtgctgggtgtaaccaatccgccttccgattacagtatggggcatttaataaccgatacttgtccacggaactggcatatcgtgggcgacaatctcaattatgcctttatcgtagaaaatcatactattctggaaaaacacccttccggatatatagaaatcagcgacagtgcattgaatcccctggaaaattacaagatagacaaccgtaagctgaacgaggccatcctctcccttaaccgattctataaataactgggagagaggccttccaccaactcctctatcaccttcggatagtattcatactccagccggtggatgcgttgcgccagctcctccggcgtatcgcccggcaatacggggcatttctgctggcagataatgctgccttcgtcataatgctcattcgtataatggatggtaataccgctttccttttcgccggaagcaatcactgcctcgtgcacacggtcgccgtacattccctttccaccgaacttgggcagcaacgaaggatgtatatttatcattttattgggataagcatgcagaatattgtccggcacacgtgccaggaatcctgccaataccacaaaatcaatatcatgctctcgaagcgtcgacaaaacaagctctccactttcccaatcgctcttggcaaaccagacacaaggcactcccagccccttggcacgctctaaaacaaacgcattctgccggttagtcaaaaccagagccacacgtgccgaacctttttcccggaaataacggatgatattctcggcattcgtaccacttcccgacgctaaaactgcgatattttttcccataatccctccaattactgcacaaaaccgtgaaaaatgtgcaaaaaggtgcatttaattcatcaaatatttgcgaggaatgataaatattcattcctttgcaccgcaaatttaaagaaataaaactaattattaattaaaaacttaaagttatgtctgaaattgcatcaagagtgaaagcgattatcgtcgataaattaggcgtagaagaatcagaagttactaacgaagctagcttcactaacgacctgggagctgattctcttgacactgtagaacttatcatggaattcgaaaaggaattcggtatctctattcccgatgaccaggctgaaaagattggtactgtaggtgatgctgtatcttacatcgaagaacacgctaagtaatcttatccattcgtttataacatggaattaaaaagagttgtagtaacaggtctcggcgccattactcccattggcaacagtgttcccgaattctgggaaaatcttgtgaatggggttagtggagcaggacctattactcatttcgatgcatcgcttttcaagactcagtttgcatgcgaagtaaaaggcttcgatgctaccaaatatatagaccgcaaagaggcccgcaagatggacttgtacacacaatatgccattgcagtagccaaagaagcggtaggtgactctgggcttgacgtcgaaaatgaggatttaaacagaatcggtgtcatcttcggcgccggtatcggtggcatccgtacattcgaagaagaggcgggcaactatgccctgaccggtaaggaaaacggccccaaattcaatccgttcttcatccccaagatgatttcggacattgctgccggacaaatttccatcatgtatggtttccatggtcccaactacgcaacttgttctgcatgtgccacttccacaaatgctattgccgatgcgtttaacctcatccgtttgggtaaggcaaatgttatcgtgtccggtggttcggaagctgccatcgccgcttgcggtgtaggtggtttcaatgccatgcatgcattgtcaacccgcaatgattctcccgaaactgcatcccgtccgttcagcgcaagccgtgacggattcatcatgggtgaaggtggcggttgtctcgttctcgaggaactggaacacgccaaggcacgcggtgccaaaatctatgcggaagttgccggcgtaggaatgtctgccgacgctcatcacttgacagcctctcaccccgaaggtttgggagccaagttagtgatgctgaatgcgttggaagatgcagaaatgaaacccgaagaagtagattatatcaatgttcacggtacatctactcccgtaggtgatatttcggaagcaaaagcaatcaaagaggtattcggacagcatgcgtatgagttgaacatcagttcgacaaaatccatgaccggccacttgctgggcgctgccggtgcggtagaatccattgcaagcatcctcgccatcaagaatggcattgttcctccgaccatcaaccacgaagagggtgataacgacgaaaacatcgactatgacctgaacttcacgttcaacaaagcacaaaagcgcgaagtgaacgtagctttgtccaatacttttggattcggtggtcataatgcgtgtgtcattttcaagaaatacgcagaataataaggtcgtgttacgtaaccaaatagataaaataaggctcttgttccgcaaggatagagagtcttatttttgtttttacagaattctcggcttctttccacgtgacatcaaggtctatcagcaggctttgctgcataaatccatctccatgcgctccgaaaaaggacgtcccatcaacaacgaacggctggaattcttgggcgatgctatcctcgacgccattgtaggagatattgtctaccgccatttcgaaggacgccgcgaaggtttccttaccaatacccgttccaaaattgtacagcgggaaacactcaacaaactggccgtggaaatcggactggacaaactggtgaaatactccacccgctcctcatcccacaacagctacatgtacggcaatgcattcgaagccttcatcggcgccatttatctggaccagggctacgaccgctgcaagcagttcatggaagagaagattttcaaaaactatatcgacctcgacaagatgtctcgcaaagaggtcaacttcaagtcaaaactcatcgaatggagccagaagaacaaaatggaggtgtcattcgagcttatcgagcagtttctcgacgaagaatacaatccgatgttccacaccgaagtccgcatcgaagggatatcggcaggtaccggcaccggttattccaagaaggagtcgcaacaaaatgcggcacagatggcattgaaaaaaattaaggatgccgctttcaaggaggaagtccaggcagccaaggagcggagccatgcaacagaaaccgccacagaagaaaatcccatggcagaagctgttgaagaatcctcacaagaaaaattagccgaaacagattcccatcctgcgcccctggacaactaagtcattgtcttccgtcaccagcttcaacttgcccgcaatctcctccagcggtgcagaagctatttcatttccctttaaggtaatcatccgcccgaactgcccgttggcaatcagttccgtggcatgtccgcccatacgtgtggaaaggttacggtcaaaaggtgtgggtgagccgcctcgctgaatataacccaacacagtctcacgggtctcgatacccgtctcatactctatctcctgagcgatatactcggcggcacgcttccgcccgtccgtctgtataccttcggctaccaccacgatggagtaaggctttcctttcttcagccgattcagaatcgtttctccgatacggtggatattatagggaatctccggaatcagaatcacgtcaccaccgcctgccataccggagtataaggctatccaacctgccttgtgccccatcacctcaatcaccatcacccgtttgtgcgagctggccgtgctgtgcaaccggtcgatggcatccgtagcaatgctgacggcagaatcgaatccgaaggagaaatcagttccccaaatatcgttgtctatggttttaggtacagacacaatgttcagccccatagcagagagtttggcggctgtcttctgcgtaccgttcccgccgatacagactacacaatcaagccccatctcttcgatattccgcgctatcagtgccggtttgtccacgccggacatcacgccgttcttcttaaagggcttctcgcgcgaagtaccgagcatcgtacctcccaagttcagcaaaccggataaggatttttcggtaaacgactccacatccttggtcagcagcccctgaaaaccgctgtgaatgccaattacctccattccataatggttgatagctgttttgcatacaccgcgaatggtagcgttgatgccgggacagtcgcctcctgaagtcaaaatacctattctcatgatatttttgtttgaattattgttctataggtccgtaaagatagaaaaaaaagagaaaaaagatagagatgccgataaataagattatttttgcggtttaaaataagatttcacaaagaacgatgaatattacaaagtttctgaataaggtatattttgctccccgtctgaaagaaatcgaacaatacaccagccatgccggtgaattgcaacagcttgtactgcagcgcctcgtccggacagcggcaaacacggaatggggaaagaagcatgactatgcctctatccgtacttatgaagatttcaagaagcgccttcccatacaaacttacgaagaagtaaagccttatgtaacccgcctgcgtgccggtgagcaaaatctgctttggccttcggaaatacgttggtttgccaaatcatcgggtaccaccaacgacaagagtaagttcctgcccgtcagccgggagtccttgcacgacacgcattacaagggaggccgggatgccgttgccatctatctgggacagaatcccgaaagtcgtttcttttccggtaaagggcttatccttggaggcagccacgctcccaacctgaacaccaaccacagtcttgtaggcgatctctccgccatcctcatagaaaatatcaacccactggtaaactttgtccgcgtacccagcaagcagacggccctgatggagcacttcgagcccaaaatggaggccatcgcccgcgaaaccatccatgcaaatgtcagcaacctttccggcgtaccgtcctggatgcttgtactcatcaaacatatattggaaaagacgggaaagcagagccttgaggagatatggcccaacctggaggtgttcttccacggcggcgttgccttcactccctaccgagagcaatacaaagacgtgatccgcagcagcaagatgcattatgtagagacttataacgcctccgaaggctacttcggcacgcagaacgaccctgccgaccctgccatgttgctgatgattgactacggtatcttctacgagttcatcccgcttgaagatgtaggcaaggagaatccgcgtaccttctgcctcgaggaggtggagctgaacaaaaactacgccatggtaatctccacttctgccggtttgtggcgatatatgattggagatacggtgaagttcacatcgaagaacccctataagttcgtcatcaccggacgtaccaagcactttatcaacgcgttcggcgaagaactgattgtggataacgcggaaagaggacttgccagggcatgtgccgagaccggtgcacaagtagtagattactctgctgctcccgtgtttatggacaagcatgccaaatgccgccaccagtggctgatagagtttgcacaaatgccggacagcctggagaagttcgccaaagtattggacgataccctgaaagaggtgaactccgactacgaggctaaaaggcagaataatctggcgctgcaaccgctggaaatcatcgttgcccgccccaacctcttccatgactggctggatagcaaggggaaactcggcggacagcataaggtgccccggctcagcaacacgagggagtatatagaggaaatgctggaactgaaccggtaaattactatatcataaaaatcaagcgcggattacgcaaattacgcggataaattaataaatccatgtaatctgcgtaatccgcgttttacaaatcagtcagtacgttttgactttactttttcatttcaacaatcagcctcaaggattagaaattatatgccagcccaattcccagcacttccttaaactgcaccttggcgcccttcttcactccattgtcatcaaacgttttcacatcattgtcatacttcagagttgtattgatggtagccgacaatactttattgattttcatgctgataagtacatcccaattcacatctatgtttccaaaatctttgctgtaaggagtaaagaaatcagccgtagtaatcagattcacattctccatcacgggcaattcagcacgggctttcacaaaagcgccaccctctatcttgaagtggtcacccgggtctacaccaaaagcacccaaatcggaaagatagtcatcagtcacgaaagtcatcttggtggaaacgggtgaaagcagtagagaatagttactcttaggcctccattccatacccagggcgatattcgaataggcaggagcaaagaaattggaaatctggtgctctttgtcgggatagtcatatcctttggcaaactgggtattcaaatcacccatcagtgtatagaaccagacgttgtctgtagaatatcccaactgagtggaaagccctattttatcactacttttcctcatcccctgagatttggttttcgacaagccatagtccagcaccatgttggtgacccagagccagtttcctttcttgtgtgtcagtgatgcattcaagtaggcatttccagcaatggaattctcacctcctgccgaccagttggccatggcagtctgtgacatattaagaccagtcactcctttcaatacccaagctccctcctgataacctttatcatccgtctgagcataagttatggttgctaaagcagcaaacaacattacaatatatatccttttcatattacagttcgttttaaaagtttctcataaaaagacgtctcataaaattaacaacatttactatcttttgttcgagaagctataaaacgaatgtaaggttcagagaataattccaccgcccaacaagtatccgtccttatcatagaaagccgctgcctgcccgggtgcaatggattccagcggctctatcagacggacacgtaacagaccttccaccgtaagagtcaccctgcaccggtttgcctgcttacggtagcgtatcttcacaataacctcgtttgcacccagcacacgactattctccaccaggttccagtctcccagccacatttcctgcctgtagagggaagagagcggagctaaaacgacttcattgctttccactcttgtctctttcacaaaaacagccttgttcagatggatacccaagcccctacgttgccctacggtataaaacggatagccctcatgccatcctaagaaattccccttttcatcgacgaatctacctttaccgggtaatagtgtttcggggacttcacactttaaaaaggaacggtaatccaaaggacaaaagcacacccctatactgtctttcttcgcagccacctgcccgaaaccacgctccgccgcatacgagcgcgcctcatttttcgtaatatctcccatcggaagcaacatacgctgcaggatgtcctgcttcaatccccacagaaagaaagtctggtctttgtccttatctgcggcaggagctatataatactttcctccggacaagactttacgcacataatgtccggtagaaatccaataaatccccttttcatcggctattttagccaacagcgcccacttcagctcattattgcagaccgtgcaaggaacgggagtacgcccccttagatactcttccacaaaatagcagataatacgcgaacggaaaagctcgcgtgcatcataggtaatgtgtttcatccccagcttcagggccagagcccgtgcatcttccaaatacccggtctcatctcctgcctcatagaaacggaaagtcacgccagtcacctcataaccggcttcctgcaacctcatggcggccacggaactatccgtgccgccactcatgccaagcaatacacgtttatctgacttcatggatacaaaagtaataaacgaaggtgaaatccgttgcatttactcttataaaacagaatatcattatagattttcacagatttattatacctttgtactcctaaaagaactaataatcaactgttatggaacatcaactgaccatttacaacactttaaatagaaaaaaagagctgttcgtaccgctgcatgcaccgcatgtaggcatgtatgtctgcggaccgaccgtgtacggtgacccgcacttgggacatgcacgccctgccatcactttcgacctgctgttccgctacctgacgcacatcggctacaaggtgcgctatgtccgcaacattaccgacgtgggccatctggagcacgatgccgacgaaggtgaagacaagattgcgaaaaaagcccgtctggaacaactggaaccaatggaagtggcacagtactacatcaaccgctatcataaggcgatggatacattgaatgtgctgtctcccagtatcgagccacatgccagcggccacatcatcgaacagatagaacttgtaaaggagatattgaagaacggatatgcctacgaaagtgaaggttccgtttatttcgatgtagaaaaatacaataaggaccatcactacggcaagctctccggacgcaacctggataatgttctcaacaccacccgcgaactggacggacagagcgagaagcacaaccccgcagactttgccctctggaaatgtgcgcaaccggaacacatcatgcgttggccttccccgtggagcgacggcttccccggctggcacgccgaatgtacagccatgggaaagaaatacttgggcgagcacttcgacattcatggtggcggcatggaccttatcttcccgcatcacgaatgcgagattgcacaatccgtagcttcccaaggggaagatatggtacattattggatgcacaacaacatgctgaccgtgaacggacagaaaatgggtaagtcttacggtaacttcatcacattggaagagctcttcaaaggcacacaccccatgctggagcaagcctacagcccaatgaccatccgcttcttcaccctgcaagcccactaccgcagtacggtagacttcagcaacgaagctctgcaagccgccgaaaagggattggcaagactgatggatgctgtacatggactggacaagattacccctgctgcaacctccaccatagacgtgaaatccctgcgtgccaagtgttacgaagccatgaatgatgacttgaactcaccgattgtcatcgcccacctcttcgacggcgccaagatggtaaacaatatcctagctggaaacgattccatcacagccgaagacctgaaagaattgaaggaaaccttccacctcttctgcttcgacatcttaggattacaagaagacaacgcctccaaggaagagcgtgaagccgccttcggcaaggtagtggacatgctattggaagagcgttcaaaggcaaaagccaacaaagattgggctacatccgacaaaatccgcaatgaactcaccgcgctcggtttcgagattaaggacggtaaggacggaagcgaatggaagctgaataaataacgaaggtatcataactcaccacagaatcatacagattggggtaagttttagacagaagaacaaaagaacatatttctctctcttgttcttctgttcttttaactgaaaaataaaatctgtataatcctatggtgattgtgtattttgatacatccctgttagaatacgaatccgaacccggcataccaccctactttcttcgtctggttggaccaattcaattgtatctccactggtcccagaaaactcttgtacatatagccgatgcctacccctgccatatcaaccgattcggaagagtcaagaatctgatgaaacttcccggagtttcgcccataactgcccatcactgatatatactggtttttcaagatacgctgtctgaggttcagccctgcaaccagcaatgcggcttgtgacagttccgcacggttgatgcccgtaaacggtatctgctgtggcatatagcgccccggtatggtcccccccaccatattgatgatggcaaaaggataattatcgcttccggacaatacgcgtccataaaacgaaggagtgacagtgagcttactcgacggagagaaacatccctgccaacgggcatcgaaaacagaaataggattgttgtccttatactggaagaggttatccgtatagagatggtaggataccgcccacgacatcccttttgtaggggcgctcctctcattcaagttgttgaacacaagtccggcaaagtaactgaataaggacgaattctcaaacagtgccgaagccaacgggtcgagcgacagcaaatcatgacagtggtagtaatcaaagtcaatgcccaaactgacctggatattgttccagtccttcgccgcccccatacggaccagctgatgtgtaaaagtcaaatccagcgcccgtttgccttcattataaatattcatatctttatagtcgaactgataggcaagtcctgcctgccatccaccgtcccattgataaccatatccaagtcgtgccagtgtacgcttgcccagacgggcggtgaggctgaccagcgactcccgctgccggccgaaatagaagtccgtatttgcctgcaacgccgccagttcttccgtatcaaaacgaaaaccgacattcaacttgttctcccgtacagcagggacggctatttgggaatcaacgggaatctccctatcaacagccgcgccaggcaagcggaaaggtcccggacggcgaggctgataatcttctgcaagtcccagcttccgtttcagggcaagcagtccgtcccaactgtccatggcagcacgctctccccgcaccatcaaagtgtcgatggcctctttggtgaaacttgcagccgaatagccggtgacatccacctttatcaatacgtcggtattacgcagattctcacggtatttcttctctccttgcagattgatgatttgcccgaagatgtctttcaccgatttcagctcggaagccttaagcagcggactctgcacatccaccccgataatgtagtcggcccccatggcaagcgccacatctaccggatagttattcaccattccaccgtccaccaacaccattccatccaggtctaccggagcaaacacaccgggaatggacatgctggaacgcatggaagtggccagtattccctcatggaacactacttcgctgccattcaccagattttccgacacgcaggcaaatggaataggaagacggctaaaatccacagaatcctggtaaccttctgtcaacgtggagaacaaacgtgccaggttcttcccttttatgatacccgcatccgaaacagcggcagatttcaaagaaaacggaatggagagtacatagcgctccgacttcaaccggtcatccagcaacacatccttaggattgggggcatccgagagcaagaatttccagttctgggcattcaccatactgtccaattgctgtggggtatatccgatagaatacaaaccgcccacaatggcccccatactagtgcccaccacataatctatagggatacccgcttcttcaattactttcagagcaccgatatgcgccgtccctttggcgccacccccactgagtacgacagccactttcggacgcccggacgcccaaaggaccatcggcaaaaacaacaaacaagcccatagtctatacttcatctccatcatttacttaatacgtattggtaatttattccactctgaatcaaacaacccgctccgacaaatagttcactatcagtcgaagcgggtcgcaaaaaacgttcaagcaatttatggaggattatctataacccatttccaatcaataaggtatcatatccttcaagataccttccttataccaaggatcatcaatctctttcaacactttgcccatctctgcgcaaaggtcttttacgacttcttggttttcttccaaagaaaggttattcatctgatacgggtccttttcatcgtcaaacaacaaacttttgaccagcttatggttttcgcggtcaatgtagagcgccagcgtgtagcgcgccgatttaaagccgcgcgacgaagggaagtaggaacggaccataccttccgcatccttctcaccgtccaggttctggatgtagagagcgccggtgggacgtacaatatccgccttttcatcgaagaaaagcggtgcatagttgcgtccctgcacctcggtcgggatggagtcggcaagaccggcaagacccaacaaggtaggcatgatgtccggcgaggaaagcatcaagtcgtccacgcggggcttaatcttattgggaaaacgcaccaggaaaggaacgttcatggactcggagtatggggaattcttcgggtcttccgtatgctggctgcacatggtctctccatggtcggaggcaaacacgacaatggtattcttgtccagtccgagttccttcaaggcatcgagtatctgaccgaaagcacggtcgacacccgtcacagaagcaaagtagtagcgtgcactctctgccttgagcatcttggagtcggcattcggacggacgagcaagctgtccagaggctggtttttatagagattgaaatcttcctccatacagtcgtccaaagaacggtacggactatggggaggattcatgcctaccataatgaagaaaggtttcttcgggtcgcgtacattcccctcgttcttcagataagacaccaccttgcccgattcgtgtaacggtgaccactcgcgcgggtcgtggcgacggccttccgtatcccagtaatgcggattcttgtgttcgtcaaaggtaccgtaagaataccagtaattgaacccatgacgacgttctttcggcgtataggcatcccatgcaggtacacggtcttccacatactgtccgggacgttcggggtcgttaggggtaggaaagtcggcatgcagtttgccaaagtaggcacagtcatatccggcattgcagaaaacatcactcacacacacagcatcctcacgcagggagctgatgggacggctcgaattgcaattcaatggaataccactcttattaggatacattcccgtcaacagagaaccacggtggggactgctcaacgggcagttgctcatggcagatgtcaataccaccgactcccgggcaaaatcattcaagcgtggggtatgcaccgggtcattccgaaagttcactttctcgcgaaaaccttcctggccccagaactccatcgcctggttacggtattggtcgggaaaaacgtaaatgacattcggctggacggattgttccgcctgcggggctttacagccctgcaaggcgaacaaacctaaaccacctaacaaaatatttaattgagttttcatttttccaagtctcttttacgcatcaatccttccaggaagtaatagtcggcataattcagcggtacatcaatctccgcaccgtgaggaatactgcccacagagtgcatcaggatgaagttgccgttggtacccaccttggcacggtaggaaggagaagcgaggctttccataatccggtcggcggtttccttgtatcccttatccggcagataagtactcagctcgtaaagggcggacgccgtgcaggcagctgccgaagcatcgcgaggttcattcgggatattgggagcatcgaaatcccagtagggaaccaagtcttccggaagattcttgttgttgaagataaagttgtagaccttttcagcctgttccaggtatttggcatcgtgtgtatagcgatagcacatggtatagccgtacaaggcccacgcttgtccacgtgcccaagcagactcgtcggcatagccttgtgcagtctgtctcttacggacttcaccggtttcggggtcataatccaccacatgatagcagctgttgtcctcacggaaatggttagccatagtcgtatcggcatgcttccgggctatgttgtagaaagtggagtcaccggacagcctggaagcttcgaacagcagttcgaggttcatcatattatcaatgataacgggacatttccagccacgttcagcctgccaccccttgtctgcatcccatgactgaagtacgcctgctgcaggacggaaacgggtagacaatgatttggctgtctgtatgatgaccggcttgtactcctccttacccgcaaaacggtatccgttcaagtagctgctgccaatcataaagcccacatcatggtgccaggtaaggtattgtaccgaatccaaatcctcggtatacttctctgccagcggcagccacttctggtcaccggtcaactcgtacatatgccagatattaccggggaagaagccggaacaccaatcgtcgataggtacatagacaatgttcccatccttatcaatggtacggggattaaggattttaccggatttttcgataatgtctgtctgaattgtctcctgagccacagcattatcaatgttttcttggataaagttgctttcagcctgcttttgccctgcgcaacctgccaatacaaggagggagattcccaatgtagtgaggactgttttcataataagggatttatttattaagagtttatgatttttcctgctgcaaaagtagagcaagtgtacagatttgacccgcctaaataattcaattaatggctaaaatcgttacttttgcgtccggaagcacatattttccacccattaatcattaatcactaaacattaatcattactccccatgaccgcacaagagttttttaagaacgaccgcttcgccacgaatgcaggtgtagaactgatagaaataaaggaaggatacagcaaggcacgcctggttatcacggcagagcatctcaatgcaggaggccgtacgcaaggaggggccatcttcacccttgccgacctggcactggcagcagcagccaactcccacggaacattggccttctctctttcgtccaatatcaccttcctgcgcagcagcggaccgggcgatgtactgtatgccgaagcacgcgaacgctacatcggccgcaccaccggatattaccagatcgacgtcaccaaccaggagggaaaactgattgccactttcgaatccagtgtatttagaaaaggggataacatcactttttccttaccacagacgtcatcggatagcggttgccccggacactcttgaagaatgccttggccgaaccgaaattcaaatacatgtccaagcgaatgggaaggtggttcttatcatcggatacgaagaaggtgatgacctccttctccttacctttcttgtactctacgaaagagaataccaagcagcggtaaacggtgtcgttattcgccttgacctcctccttgccgcggtaaatcaacgtctgctcttccaccctgcgtcccgtggccatgggaaagagtatcttctgccctaccttgtagtctttagggtcataagagcgcgcctgcgccaaaatgctcaacatatcgaagatacagcgactatcactgtattccatctcctgagcctcacgcacgggattgtgccaggtgcgtctctgctttacattcgccagtccgtccgagtaggagaaccaagcctcgtccaccgtatggcggcttccctcctccgccgctttacggaagtagagcggctccaacctatcgctgacataacaagtcaacgtatcacgcatcttgaagaaaaaatcggtctttttactgcctacacaaagcaagttaaagcgaaatgcaggctcggaatggtaagtcgtggcattggtagtgaggcttgccagacccaccttcttccaaatgaacttccaattgaaatataaatcgtacatgacatgctcgcccgactggaaagcttcattctttgcagtacattgggcctgaacagactgggaggttcccaaacagaccgctcccaccattaatagaatgaacaattgcttccgcctaatagctatggcctctaccactgttgcggctgctattgccactgcggttatttttgttcctgttttgctttttcttgtcttcatctggtttttgtttttttagttcgtccggcttctgcctatccagggacttggccttaatatcccattcctgggtcaaatcaaagttcgctttaagctccagaaccatcggataatagtaaaccatttcaggctggcgcttctcggcatagtttcccgtatcccagacaccattcccattcgtatcatttatcagccgcgctccatatttgcccggattgaggaaatagaaatcggctttcccatccaccaccggcaccgtgcgcagcactttgtcctgaccgtccagtagttccacaaaagccagagagtccgctccatgcacattaaagaatatctgcccgtactcttccagcttcttggccttgaagtccttctttatcttgtcggagaacaacccgtacaacccgcgtatggcagcagaatccacttcaaatgtatagctttcgccgggtgcccattcggcaaacagattataacgcttcaagtccaaagagtcgcgcataaagtcgaacgggatatcctgccacaacgagtccactttcagtttcagatggaaagcggtggtatctatgcttgccaccggctccgtaaacgacagagtaagataatcatatacatcgattgcagaaggggcatacacatctacagccaggaattccgtcggctcgggctcttccacctcaccttccttcaacttcttctttttcttctcacgctctttctgttccttttccttcgcttcctgcttctgcttctgctgcttgtcgtatgtcaacttcgccagcacattcaaagtatcggtacggggtaccaatcgtttcaggctatccgtatacaaataggtgatactcattttcagggaatcctgcttatagagcagagaatcctttatccaataatgaatcgtatcgttccggccggtaggctgttctataacaaacgcatcttcctcattaaagttcaatcctttcaataaaggcaacgtgtctgccggagcagtgaaatagagcgaaaacttctccggagtcaaccgttcggccttcaaaaaacgttgcgagaaggaaagctccttgaaagcacgcagcagaacatcatccggaaggtagtgggtatattgacgttctacaatcgtatctactgtcagcgagtctatccaggtcgtatcctggcgcatgcgctcttccatggaaggaatgatgatagagtcattaaaagctatcacttccgtcggctgggaataggcaaaattctggtcggcatcctgcaaggcataaatgcgatacttgccgggagccactccacggatagagaagcgtccgcgactgtccgtacgccccacccgctcaaaaggaagtttggtaaaagcggagtcggccagattggcatgcagaccgaccagcattcctttcaccggttcaagattggccgcattcagtactgtaccggccacagccatagagtcgagacggtcgcccgtagagaaagaatagaagaaattctccaagggattcccctcattattatcctggatggcatcaccaaaatcgaatgtataagtagtattgggtttcaatgtatcctgcagagtgatgaccaccttcttcccattagacttaatttcgggctgctgcacctgcggaggggatattacaatcttctcattcggcttgtcaagcttgataaattcatcgaactcaatggaaagtttatttttattgtgatggagtgcgccgggcgtgggagtaccggaaataaaacgcggaggagtctcatcataaggtcctccttcaatacggcccacactggcacaagaatacagtgcggcagctatggcaacaccccccaacaacctgcggaaaagcggcttcattttagtatggcgtttacgttctaacatgctgcaaaaataaaggttatctgccaattagcggtatgctttacagtattttaatcaaaaaatgtcctttcgttctcatctatgtatgaaacatagttaaaaaaggaagtgtttcaccccttatatactaagaaaagaatatttttgcagacgaaaactgaataggagtattcagttttctttttcctgccttatttctaaatcatgaattacacacgaaaacgcctttcaagaatcgaaaaaaagaagaatataaaattatacagagaacaaaaaagagtatgaagagtagattagtattattggcatgttgcctggcactgctcagcagttgcggacaaggcgacaaaggaacgggtaaagctcccgaatttgcagtgattgaggcaaagaccaccactgccaacttgacaaacagctaccctgctactatcaagggtaaacaagatgtagaaatccgcccgatggtgagtgggttcatcacaaaattgcacgtggatgaaggcgcaacagtgcgcaaaggacaagtgttgttcagcatcgaccccgtacagtatcaggcagccgtaaattcggccaaagctgctgttgaaacagccaaagctgccgtaaacacacaagaactgactgtaaacaacaaacgtgaactgaacaagaaaaacatcatcagtgactacgatttgcaaatggccgaaaaccagctggcacagacaaaggcacaactagcacaagccaatgcccaattggtcaatgccaagaacaatttgtcatacaccagtgtaaccagccccagtgacggtgtagtaggtagcattccctaccgcgtaggtagcttggttagtccttccgtagccagcccgctgactaccgttgccgacatctccgaaatgtacgcctacttctccatgaccgaacgccaactcttgtcacagattcgtgaaggcggtagcaccaaggaaattctggaaaagatgccgaatgtacagttgcagctcatcgacggaaccatgtatgccgacagtggccgcgtggagacaatcagcggagtcattgaccagactaccggttcggtaaccatgcgtgccctcttccccaacaagcacaacgtgctgcgtagtggaagcaccggcaatgtggtattccccaacccgctgcatgatgtcatcatgattccacagtctgccactaccgaaatccaggacaagcagttcgtattcgtactgcaaccggacaacacgctgaaaaataccgaagttaaagtgttcagcttagacgacggcaagtattattacgtgacggaaggtttgaaagcaggcgaaaaaatcgttatcgaaggggtacagaacctgaaggacggacagtccatcacgcccatcacgcctgctgaaaaggaagccgaataccagaaggccctgaaagaccagaaagaaggcaatattcagactgcgtttcaatgaaagaatgaaaaataaaaaaattcttcaatttttaattccttaattgttcatgaaatgaaattagatagatttattaaccgtccggtactatcaacggtaatttccatcctgatagtaatcttaggagttattggtctggctaccttgcctatcacccaatacccggacattgcacctcccaccgtatcggtaagtgcgacttaccaaggtgccaatgcccaaacggtgcttaactccgttatcgctccgctggaggaccagattaacggtgtggaaaatatgatgtatatgagttcgagcgccaccaacagcggttcgggcgacatctccatctacttcaagcaaggtaccgaccccgatatggcagcggtgaacgtacagaaccgcgtttccatggcgcaaggcttgctgcctgccgaagttaccaaaatcggtgtaaccacccgtaaacgccagacttccatgttgatggtattctccatctatgatgaaaaagaccagtacaacatcgagttcctggaaaactacgccaacatcaaccttatccctgaggtgaaacgtgtcaacggtgtgggcgatgccatggtattgggacaagactactccatgcgtatctggctgaaacctgatgtaatggcccaatacaaacttatccccaacgatgtggttgccgccttgagcgaacagaacatcgaagcggctcccggccagttgggtgagcgcggtaaccaaacctaccagtatactctgcgttacaaaggacgtctgcaacagactacggagttcgagaacattgtcatcaaggccttggagaacggtgaaatactccgtctgaaggatgtagcaaatgtggaactgggccgtctgtcatacggattcaacaatatggtaaacggacataaagccgtgagttgtatcattttccagatggcaggcagtaatgccacgcagaccatctcggatatcgaggccctactggacgactattccagcaaactgcccgccggcttgaagataaacattgcacagagtgccaacgacttcctcttcgcttccatacatgaggtaatcaagacattgatcgaggcctttatcctggtgttcatcgtagtgtatatcttcctgcaggatatgcgctccacgttgattcccgccatcgccattcccgtggcgttgattgccaccttctttgtattgaaactgattggcttcagtatcaacttgctgaccctttcggccatggtgcttgccattgcgattgtggtcgatgatgccatcgtcgtcgtcgagggcgtccatgccaagctggaccagggctacaaatcggcccgtacagcttccatcgacgccatgagtgaactgggtggtgccatcgtctccattacgttggtgatgatgtccgtattcgttcccgtgagcttcatgggaggtacggcaggtactttctaccgtcagttcggtttgaccatggcgattgccatcggtttctcggctctgaacgccctgaccctgagtcctgcgctgtgtgccatcttcctgaaacctcacaacggcggacacgaaagtctgaaagagcgtgtaggcgttgccgccaaggaagcccgcaagattatgattgcacgttatgccgactctataggccggttgatgcgtcccggcattacactgctcttcgtgacggtagctatcctgggcatgattttcggtctgttcagcttcagcgaacaccccattctgtgtagcttgatgattatcatcagtgtgctggcgttggcaggtatgactaccgacaagttcaaacaatccttcaatgactcatacaacggtatcctgggcaagtataagaaacaagtgctgttcttcatccagaaacgctggatatcggcaggactggttatcggctctattgtactgttgggcgtattcatgcagataaccccgaccggtatggtgcccaacgaagacaccggtaccatcatgggcgctgtgacactgcctccgggcacttcacaagaacgcgcacaagagattttgaaccgtgtggacagcttggttgctgcagaccctgccgtacagtcacgtaccgttatctcaggttatagcttcttgggcggtcaaggcccctcctacggttcactcatcatcaagctgaagaactgggaagaacgttccacgatgcagaactccacgattgtgtacgccactttgtacatgcgcgcccaaaagattatcaaggaagcgcaggtattgttcttcgcgccgcctatgattccgggttactcggcttcaagcgacatcgagttgaacatgcaggacaagacgggtggtgatttgaaccacttcttcgacgtagtgaacaactataacgcagccctggaagcacgccctgaaatcaactctgccaagacatccttcaaccctcacttcccgcaataccagctggacattgacgctgccgcttgtaagaaagcaggcatcagccccaatgacatcttgactaccttgcagggatattacggtggtttgtatgcttccaacttcaacagcttcggtaagatgtaccgcgtaatggtacaagccgaacctgatgctaccaagaatatggaaacactgcaaagcatcaaggtgcgcaacggcaacgagatggcacctatcacgcagttcatctccatcaagaaagtatatggtcctgacgtcatcagccgttttaacctctacacctccatgaaggtgatggtggctcccgcatcaggctacacttccggtcaggctctgcaagccattgccgaagtggcgcaggaaaacctgcctgccggtttcggttatgagttgggaggtatggcgcgtgaagaggccgaaacgagtggcagcactacgggactcatcttcatattgtgcttcgtattcgtttatctgttgctgagtgcccagtacgaaagctacatcctgcctttatccgtattgctgtccgtgccgttcggtctgctgggtagcttcctctttgtaggcggtataggcgcattgggcagcatcccggcactgaaaatgattctgggcacgatgtccaatgacatctatatgcagattgccctcatcatgttgatgggtctgttggccaagaatgccatcttgattgtagagtttgccctcgaacgccgcagaatgggtatgagtatcacctgggcagccgtattaggtgccgcagcccgtctgcgtcctatcttgatgacgtcgttggcaatgattgtcggcctgcttccgctgatgtttgcttccggtgcgggtgccaacggtaaccgtacgctgggtacgtctgccatcggcggtatgttaatcggtatgattctgcaaatcttcatagtgcccgcactgttcgtggcattccagtacctgcaggagaaattcaagccgatggaatgggaagatgtggacaactcggatgcagaacctgagattgaacaatatacaaaatagtgattaacgattagcgattatgaagaaaataatatgcctgatgtgcgcaactgctttattgagcagttgccacatctacaaatcatacgacagacccgaagacataacaactgccggactgtatcgcgacacggcgtccgtgaacgatacattagccgcagatacagccaacttcggtaatctgccttggagagaagtgttcacagacccacagctgcaggcacttatcgagcaagcactcaccaacaacggtgacctgcgcagtgccgctttaaacgtgaaacaagcacaagccgcactgatgtctgcccgtcttgcctatgctccgacgcttgccttgtctccgcaaggaaccgtcagcagctgggacaagggaaaggctacacaaatctactccctgcccgtcaccgcaagctggcaagtcgacctcttcggtcaactgctgaacccgaagcgacaagcaaaggttagcttgaagcagacgcagttctacgaacaagccgttcagacgcaagtcatcgccggcgtagccaacatgtactacaccctgctgatgctggaccgccaactccaaatcaccgaaggcaccgtcgagattctgaaaaagaacctggagaccgtgcaagccatgaaagatgcaggcatctacggaaccacttctgctgccgtagagcagagccgcactgcctacgctcaagtcatggcatcactgcccgacatacgccagagcatacgcgaaaccgaaaacgccctctgcctgatgttgtaccaaccggcacagagcatcgcacgcggtgtgctggaagagcagcagctgcctacggaattttcagtaggtatccccttgcagttgctatccaaccgtccggacgtgaaagctgccgagatgtcactggctgccaactactataacaccaatagcgcccgtgccgctttctacccgcagattacattgagcggttcgggaggctggaccaataactccggtgcaggtatcgtcaacccgggcaaactgctggcttccgccatcggttcgctgacgcaacccttgttctatcgcggtgccaacattgcccgtctgaaacaagccaaggcacaagaggagcaggctaagattcagttccaaaccgccctgctgaatgccggaaatgaagtgagcaacgccctgcacctgtatcaaatggagaaggacaaagccgtttcacgcactattcaagtaaattctgcccgccaagctgcctcagatacaaaagaattgtttaacttaggcacgtcgacctatctggaagtcttgtctgccgagcagtcttacctcagcgcacagcttgcagaagtatccgacaccttcagcagcatgcaggcagtcatcagtctgtatcaagcgcttggaggaggaagagaataaaatgagcgataagtgattagtgattagcgattaatgaaatagtaaatcctaatcactaaccatttatcattaatcattaatcgctaattactatgataagtccgttagcttatgtagattctgccgcaaaaatcggcaagaatgtaaccatccagccctttgcatttatcgaagggaacgtggaaatcggtgatgactgtattattatgtcgggggcaaaaattctgcacggtacccgcatgggaaaagggaacaaggtgcatcacaatgccgttctgggtgccgaaccgcaagacttccattatacgggagagaacagcatgctgattatcggtgataataacgacatccgcgagaacgtggttgtcagccgtgctacccatgcaggaagcgccacccgcatcggcaatgaaaactacctgatggatggtgtacacctctgccacgacgtgcagataggcaaccattgtgtactgggtatcaagactaccgtagccggagaatgtcagatagacgattgtaccattctgagcagcaatgtcattctgcaccaatactgccacattggaagttgggtactgattcaagctggctgccgcatatcaaaggatgtgccgccctatatcatcatgaacggtaatccggcagaataccacggtatcaacgctgctgtgcttcaacacaaacaccaggtgaccgaacgtgtattgcgccatatcgtaaatgcctaccgtctggtataccagggaaacttcagcgtgcaggatgccttgcagaagattgaagaccaagtaccgatgagtgacgagatacacaatatcatcaacttcatcaagaattccaaaggaatcgtgaagtaaacacccttcttcgggcacgaatcacgcagacaatacggatgaataaattcttttctgtaagtctgcgtagttcgtgcctttttctatattcctctacaatagttcctgcattatcttttactattttttgatgtatattcattccaggcagtatgctaagtaaaacaaactgtttcctttaactaaacattttgtttccttatagaaaacactttgtttcccttaacaaaacagttcgttccattatatgaaaacaaagtgtttttctatactgaaacaaagtgttctctaatgctggaacaaactgttcagtgttgtgaactaacggattaagtatataaagggtatttattatactgtttctgtagacaatggtctgtcttgtcctataaaagacggggaaagaagcaggaagcaaccgggtacgctcggaagggtgagggtaaaatttgccctcaccctttttatttgctctcactcacccttgaaagggcgatgaatagggagtttcagaaaagcggtgatagtggtgagggcagattgagtaattttttgttctactactactcgaaatgcagggtaccgaagaactccgggcaatggaagttcggcttctccagacctatcggattccaggaaaggaaatggggagtctggagcttgtcaccgcatttataaaaattggcacggagcgtctttccatccaacgaagtgatgtcatgcaggaagaaagcggaataagggatgaccagggccacttcccaggcacactcacctactctttcgtcgaaagcctcacgtcccaaagaagcccaacgctgtactttatcgagcacctcttgcggggcatgctggcggtttccacgtccggcacctgccccaataagcagagttccggcacaattacactccatattgtagtacactccgtcaccggcaggcacagagaagaactctacacacgcatcttcccaaaccggaccgttatcgtggcctgcaactgcgcgtacactcgcttcccttaccttgaaatgcagcagaatggcatcttccgtatgcgctatgcggaattccacatcgggagtataaggaaaagcagcccaattcactgtgtttacgggctgaaacgccaccttctcttcatccagaagagccggaaccgactctaccggtatattggccgcacttactttctttacattcaattctttcattttactattttggggattaattgcagacagcggcaacatgcaaagagctgccgccatcgtcattaaaaactttttcagatacatgagtcaatgaattttttcatctccggtgtatgctcctccacgctctgcaacagtttgaactgagccttggtacgcacaagattgtgctccggatactggattttataataagtatcaccgttgatataatctgccaggaagcgtacgcactgcatgtatgggaacaaggcagccgcataaggcagattctcaatctctatcggcaacaagaaggatttgcccgattccagataacccttggtaaatgcctggaatatttccatattgaagttcacattatccagattcttgtcgtcttccaaccccgtgttggcacctgagcgaaggaaatcgccataatcggagaagatgaagctgggcatcaccgtatccaggtcgatgacacaaagcaccgtaccgtcttcgtcgaacatcatgttgttcactttcgtatcacagtggcatacccgtttgggcagtttgccttcacggtacagacgttctgccttacacatttcatcagcgcgtttttctatctcatccagaaaataccgcacctcctgcacacgtcccgcagcatcggcagccacagcgtcacggagttgcttcaggcggaactccatgttgtggaaatcgggaattgtctcgcccaatgtatctggaatgtcggcaagcatagcctggaaattaccgaaggcagttcccgcataataggaatattcggggttcaccgtctcgtaagtcttggcacggggaataaaagtcatgatacgccagtagttctcaccgtcataccaataggttttcccttcggccgtggggatgaaatgaagcactttacgctcgacatcggcctctcctttctcttccagcttcttacggatatgcccggtcacagcctcgatattagactgtaacatctctacattctggaaaatggcatgattgatacgttgcagaacatagtccggcgcatcggcctcaacggtggtcactttgtacgtatcgttaatcaggcctgagcctaaaggcttgatttcacgaaccgtaccctgcatttgaaaatgagatacaatagataaaaggtctttcatgataataaatgaattaatttgtttacaaagatacgccgattgccatctatcaaaagacaagtatcgttcggcgcgcttccaaaattatacatttatccaaacataaccgcaaaaactgcctaataaataagaagtcttgtacaaaatatacctatatttgtaactgaaaccttaaaaactacccgaaaagtgcgaacgtttatcatccggctgcttcttgtttcagtaagcatgattgctgcaaccctgcaggcgcagaacatcaccttcaaccatctgacaaccgacgacggtctgtcacaattctccgtgaacagcctttacatcgatgaaaacggtgtcttatggattggaacccgagaaggcttgaaccgttatgacggagaagacatacaaacttacaagctgcagaagaacgacccttacagccttttctgcaacaccgtgctgcgcatggccggcaaccgtaacggaaaaatctacctgctctgtacggaaggagtagccgagttcaatctcgccacccaaagattcaccaccctgctgcaaggaaatgtacacagcatatattacaaagaggcccttttcatcggaaaacagaatgaaatctaccgctataacgagcagaccgggaactttgacctctattaccagcttcccggaaaaagtctggaaatctgctgtatgcatctggacaaaggacaaatgtggattggaacgaccaccgacggagcataccgcctgcaactggacaagaacgagctgacccaccccatcctgaaaggcaacatcaccagcatataccaagacagcgaaggcgagttatggattggcagctgggaagaagggctgcaccatgtaaagaccgacggaaccatcgaaatctttgaatacgacgcaaagaacccttacagcatctcttccaacttcgtgcgagcctgctgtgaagacaatctgggaaacatctggattgggacattcaacggattgaaccggtatgacaaaagtacgggactcttccagaaccacactgccagtgatgcccagagcgacggactgacacactcttccatctggtgcatcgtaaaggacaaccaaggaacgctgtggctggggacctactttggcggcgtcaactacttcaaccccgagtacgagatatacagccgctatatgtattcgcccatcgaaaagaaggggctgagcaatccggttgtaggccgcaccatcgaagacaaggacggcaatctgtggattggcaccgaagggggcggactgaactattacaaccgccgtacccgtgagttcaaatggttccgcccggaaatcggtcccaacagtatttcccataacaacatcaaggctctctattatgatgcctccaaagacatcatctggataggaacccatctgggcggactgaacagactggacatacgctcggggcgattcacacactaccgcatggaagcaggtaatccggagaccttgccttccgacatcatccgcgatatcgcgccttaccaagaccacctggtgatagccacccaaaacggaatctgcctcttcgaccctgccaacgggaaatgccaacaactgttccaggacagcaaagaaggcaaaaaaatcaagatggtggcagatgtcactttcgacagcaacggtacgctctggattgcagccacgggcgaaggtgtgttcagctaccgtttcgataccggcaaactgaccaactaccgccatgatactgccgacccacacagcatcagcaacaacaatgtaaacaacattacccaagacagcaaaggcaatctgtggttcgccacttcgggcagcggactggacttataccgccctgccagcaacgacttcgagaactttgaccaagcgaagaacggcctttccagcgactgtatctatgagacggaggaatcccccaccagcggcaaactgctgctcatcaccaacgagggcttctccatcttcgactaccggcaaaaggcattcctgaactacagtgccgaaaacggtttcccaatgactgccgtcaacgagaatgccctttgcgtgacccgtgacggagagatattcctgggaggcacgcagggaatgatttctttccatgaaatggagttgaacttcacgccgaaaccctacaaaatcatcctctcccgcctcattgtgaacggaacggaaatacaagtgggagatgagaccggtatcctgcagcaagccttgtactgcacccccgagattacgctcaacgctgaccagtccatgttcagcatagagtttgccacttcaaactatgtagccgccaacaaagacgacatcatctataagctggaaggcttctccaacgactggaacagtgcccgtggactgcacaacatcacctataccaacctgaacgccggaacctataacttgattataaagcccaacggaaaagacgagagcctttgtccgcaagtccacctgaccatacacgtgttgcctccctactacaagactccccttgcctatcttatctacctgatagtgacgggaatcctgctctggtatctggtgcgtacctacaagtccagaatcaagttgcgtgaatcactgaagtacgaacagaagcacatccgtgacgtagaggccctgaaccagtcaaagctacgtttcttcaccaacatttcccatgaattccgcaccccgctgacactcatcgtggcccaagtggaaacgctgatgcaactccagaacttcacgcctgccatatataacaaggtactgggcatctacaagaacagcatacagctacgggaactcatcaccgagctgctcgacttccgcaagcaggaacaagggcacatgaagataaaggtaagtccacacaacatcgtgaacttcctatacgaaaactatctgcttttcctggaatatgccagcgccaaacaaatcagcctctacttcgagaaggaaacagacagcctcgaagtatggtatgaccaaaaacagatgcagaaagtgataaacaacctgctgtccaacgccgtcaagcataccaaggcggaagacagcatcaccctcagcatcaagaccgaaggcagcaatgccgtcatccgcgtgaccgataccggcagcggcatagatgcccgggaagtggacaagatattcgaccgcttctaccagatagaccaaatggactctacagatgcaagcaagacgggtacgggtatcggcctggcattgacgaagggtatcgtggagctccatcacggcaccatccgtgtggaaagcgaactgggcaaaggtagcagcttcatcgtaaacctgcaattggggaacgcacagtttgacgaagagcaaataaataagaatgcagacagtgtgcaacaaatagaaattcccaaaccggaaaacgatgccctgctcaaggcggagctggaagagagtgctcccatcaaacgactcccggatgcaaaaatcctgatagtggaagacaacgactccatccgcgacatgctggcaggtatcttcaagcccttctacgaagtgctgactgcggccgacggagcggaaggacttgcactggtgcgcagcgaaatgcccaatatcgtagtcagcgacgtggtgatgcccaacatgtcgggaacggaactgtgcaaacagataaagagcgacttcaacacctgccatattcccgtggtactgctcacggcacgtactgccatcgaacagaatatcgagggactacgcatcggtgcggacgactatatcaccaagccgttcaacaccaatctgctgatttcgcgctgcaacaatctggtaaactcgcgtattcttctgcaggagaagttcagcaagcaaccacaggctttcgcacagatgcttgccaccaatcccatagacaaggagattctggaccgcgccatgacagtcattgagaaacatctggacgatacggaattcaacgtcaacgtctttgcacgtgaaatggcaatggcacgcaccaatctgttcaccaagctgaaggctatcaccgggcaaactccgaacgactttatcctgactatccgcctgaagaagggtgccctgatgctgcgcaacaatccggaactgaatatcaccgaaatttcggaccggataggtttcagttcttcacgctatttctccaaatgcttcaaggacatttaccacgtcagcccgctggcctaccgcaaaggagagaatggaggagaggaaagtacggaagacagtgaagagacatcttaatattgtacatcaagccatcgcatgacacggtttgtactttttctcccctcccttgtacttccttatacacccgattccacaaaacctcttacctttgacctcagaattacaatctaaagtcaaagaactatgaagcatttttcccccttgtggtctctgcttcccggtgcagccctgatagcgggatgcggaagccaatctaaagacaagacttcggagcactctccgcagaagcccaatgtagtatatctgattgctgatgacctgggcatcggcgacctgagttgttacggtgccaccaaagtaagcactcccaacatcgaccgccttgccggacaaggcatgcagtttaccaacgcttatgccacttcttccaccagcaccccttcccgcttcggcctgctgacaggcatgtatccctggcgacagaagaataccggcattgctccgggcaattccgaactcatcatcgataccgcctgcgtcactatggccgatatgttcaaagaagaaggctacgccactgcagcagtgggcaagtggcacctcggcctgggtcctaaaggcggtacagacttcaaccactccatcaaaccgaacacccaagacatcggctttgactatgaatacatcatccccgctaccgtcgaccgcgttccctgcgtctttgtagagaacggacatgtagtgggcctcgaccacaacgaccctatcactgtgagctacgaccacaaggtcggtgactggcccaccggtctcgaaaaccccgaactcgtcaagatgaaacccagccaggggcacaataacaccatcatcaacggcatcccccgcatcggctggatgaccggcggcaaatccgccctttggacagacgaagacattgccgacgtgattacagacaaagccaagaacttcatcacagcccataaagacgaacctttcttcctttatatgggtacgcaagatgtacatgttccccgcgtgccacatccgcgtttcgccggcaagagtggtttgggcgtacgtggcgacgtcatcctccagctggactggaccgtgggtgaaatcatgcacactttggacagcctcggcattgccgacaacaccatttttgtattctgcagtgacaacggtcccgtcatagacgacggctatcaggaccaggcacgcgaactgctgaacgaccatactcccatgaagcactaccgcggtgggaagtacagcgctttcgatgccggtacccgcattcccttcattgtacgctggcccaatggcatcaagcccggcaaacaacaagcccccttctccatgattgatgtatacgcttcactcgccgccctgctggaccatccgctggaagcaggcatcgctcccgacagccgcgaccagctcaacaactttctgggaaccgacactgccggatgtgactatattgtacaacagaatctggacaatacactctccattatccagggagactggaaatacatagagcccagcgacaagccggcactggagtattggacgaaaacagaaatgggaaacgccccgcagccccaactgtacaatctttccattgatccgtccgaaaaagacaatgtggcagaagcccatccggacaaggtaaaaacgctctctgccctactggaagaggtgaaggaagcaaagaaccaaagtgaaagggaataaaagtacaagagtggtatagttcgcaagttttgtacgaattcgtactttttgcgaactattaactaatgcatttgtatattccatcccctacatttgcgatgtgattcaactctgaagtgagtacaaaacaaagaaacaacctttattaataactaattaaattaatatttatgaaacagaaatccagcttctttaaagcattaggtattatgttgctttctgtcctatttgccacgcaggccaatgcacagaatctcacagtaacaggtacagtgactgacaacttaggtccggtgattggtgcttctatccaggtggaaggaacaagtaacggatgtatcacagacattgacggaaactacacccttcccaatgttccggcaaacgcaactctcgtattctcctatatcggatatcagacacaaaagattgccgtaggcggaaagaccaaaatcgacgtaaaactggcagaagacagccaattgctgcaggaagttgtcgtagtgggttacggcgttcaacgtaagagtgacctgaccggtgcagttgcttctgtaaaagcagcagatgcattgaagaataccccgaccggtaatgtatccgatgcattgcagggacgtatggccggtgtatcagttctctctggttccggtaatcctactgaagacaataccatccgtgtacgtggtatcaactctatcacagcagaaaccggtcctttggttgttatcgacggtttcatcggtggttcccttcagtcgttgaatccttccgatattcaatctatcgaagtattgaaagacgcatctgcaacagctgtttacggttctcgcggtgcaaacggtgtaatcttggttactaccaaaaacccatcccaagacaaattgactgtatcttttaatgcatttgccaacatcaagactgtagccaagtatgctgataatctttctacctatgaatatgccaacctggttaatgactatggtaaggaatattttggatacggcgacaatcactattatagtgcagagcaattagcagccttcaagtctggcaaagcaggttatgattactcaagagaaatcttccgcagccctgccgttacacagaactatgaaatgtctattgcaggtggtggcgaaaagactactttcctggcatctctccgctatcaaaacgatgaaggtatcatcaaggagtcaagtagccaaatctacagctggcgtttgaaagtagataccaaaatcaagaagtggctgaaagctggtatgaacatctatggtcactacagagaaacaagtactccacgtgtcaatgaatatgatggtttaatccaacaagcaatgtactttcccagtactattgaaccgcaagatgaagatggaaactacaataattcattttttgagggtagttcaacttacaatccaatggggcatatttgggaagcagacaatgccaacaagacaataaataatcgtatacaaggttatgtccagtttgacatcatggacggtttgagcttccgctcacaactgggagttctgcttgacaatagactaaacacttccgtacaaaatgacaaaagttactatgctttcaagaatagcaatttatcgcaaggtcaagcacgtagttactggaacacttcctggttaaacaccaacacattaagttatgtaaaagaatttaatgctaatcatcgtgtcaacgcaactgctgttttcgaacagtcttatgataataatttcaatcataccggtactgcttatggtttggattatattgataggatcggtataaacaacttggcatggtcaaatgcagagcttgctaccaatagctccgaccgtgttatcaatacattaatgtcaggtatgttacgtgtaaactacgtatttatgaaccgttacatggttactgcatctattcgcgcagatggttcttcacgtcttgttgataaatggagctatttcccatctgcagctttggcttgggacttgaaacaagaaagttttttgaaagacaacagctttatcgaccaattgaaacttcgcctcggttatggttctgtaggtaaccaagctgtagaagcttaccgcccctattccaaacgtactccaataagaaatagtgatggctccacctcttataaagtagaccgccctgctgctccttacctaaaatgggaacgtaacgaccagttcaatgcaggtgttgattttggtatactcaacggtcgcatacgcttgactgccgattggtatagcaaattatccaaagatattttgttggatctggcacaaccaacacacatgggatttccctcattgttgatgaactctggcgaaatcaagaatactggtatagagttcacaatcagtgcagacccatttaccggtaaaggcttcagctggcataccgacgttactttatcgcataataaaggaactttcaacagcatacctacagctaaccatcgccaacagcaagccggaagtttccaaaatcaattattccagatgattgaaggtgaaaaattaggtacattctggggatatactttcggaggtatctggcaggaagatgaagtgaacgctccattcgtagacgccaacggtcaaacaaatggcaaaacaaacggtgaagtctataaagtcgtagctggtaactctaaatatgtagataccaataaagacggagtactgaatgatgcagaccaaggtatcatcggctgtggtcaaccgacatttaactggggttggaacaatagcttcaattacaagaattttgatttctcattctttatggtaggtttccatggctttgatatatacaatgcaactcatcaaatgggattcaatacagtttccggtcagaacatggctgcagtaactccaatgcgtgacttcttgaaccgttggacgccaaccaatacaaatacagatgtaccgggtttcgtacaaggaggcacagaaaacaaagtattcagcagtcgttttgtagaaaatggaagctttatcaagatgaaaagtatcaccttgggttacactttgcccgaattagcctgcaaatcacttggtatcagcaatctccgactttatgtttccatccagaatccgttccatatcaccaactattccggtctggatcctgaagcaacaatgggaagcccactgatacaaggtgttgattggggctcatatcctaacagccgtaattatctgattggtttaaattttgcattctaatgatttaccttttaaacaagaataatatgaaaaaattagcatatatagcaacaatagcctgcagtatgttcctgacaacttcttgtgtagacctgacccaagagccacagtctttcattactgatgaagattacattgccagcatggacctaacaggtcttcaacaagctgcaacaggactttataacgatttatggaatgggaactatggttttaactgccgtttacaacgcataaatgtatgtgcagatgatattacttatcgtgcggcaaaagcaaataatgaattggccaattactatagactatctcccaatatcacagccaacactgcagatttcgatactacttggtcactattttttgccgttatcaaccactccaatacacttattaataagacggtattaccggaaaatgcagaccaagccaagaagtttgaagaagtattaggagaagcttacttcctccgtggactttcttatttttatttggtacgcatgtatggtgatgtacccctaattctagcagaaacagacgcttcaacgtacatgccgagaactgctgttgcagaaatctatgatcaagcgattattcctagcttgaaaaaagcagtagaaatattaccggcaaaaagtcgcagcggcttcagctctactccttccaaatgggcagccgaagcttgtctggcagacgcttacatgacaatggccggttggcctttgaaaagaggacaagagtattactcactggcagcggctgcagctaaagacatcatagacaactctggtttgtacctgaccgaagaatatgcagaattgtggaaagaagccaataaagcacaacccaatgaagtaatgtttgccatccaccataatgcgaagatgaagacggcaagtaactatggaaagtcttactaccccagcgattttgcccccaatgccggttggtctgactactatgcaaacgaaagcttctttctaaattatccggatgatgcacgtaaagagtggaattatatgacagaatgggaaactaaaaacggtcatgtcacttataaagaaagtgccgataagcttcccgccatttccaagtattatgactatgacaacggcgcacccggtaagagtgcccaagctaatggtatcacttgtatctaccgttacgccgatgtcctgctgatgtacgcagaagcttccacccgtgccacaaacagtgtaaacgcacaagctttggatgccattcagaaagtacagaaacgtgccggttatgcacaagaccagctgaccacaactactgatcctacagctttcacaacagctgtattcaacgaacgcggttgggaattctttgcagaaatgaaacgttggttcgaacttgttcgtctggaaaaggtaagtgaagttagagccgagacttggaatggttcgcttttccaaagcaacaaccattattacttccccataccttatcagcaaatccgtctgacacagtggactaataatgcaggctactaatactgataaaaacgtaataacacaaaacttctaaccttatttatcaagaaatcaaatagaccttaatcaatttgatatgtacgaaagggaggggccgtgaggttcctcccttttatttatcaatacaatgtaatactacccaaacaacatccaactaaatcagggaaaagacatccagctggaaactaaaagcttcatgctgaaaactaacaatataagactatccctaatagataaaacaacgatatcactctatttccaatactctcattagagcgtgatagataggtatgaaaaaacacctatcacaccctaataaatttataatcacatatatactcctttgcgtgatagcgtgacagatgtttttatttttttgtgtagaaacaaaaataccagtaaatgctatttcttttccgtactttcaaagtggcgttgctgctgttccacctgcttcatttcattgatacgttcctgctcttccctggcaaggcgctctatttcattgaagtcaatctctccgacttcagtttttccaaagatttccgtcttttgcggaaccggaagctctctatacaaggctacacgttccgcaggcaaagtagctatttcaatcactgcctggggatggaactgtatacctagatgcaaaagacgtgcttttattttgatagtacctgctttcgttgttgtacggatcagtgcaggtgcagtcccccaacgactgacacggggattggcttctacctctcttccaccgaccaactctccttctccttccacctcaaaaataacggtttcttgagaaaggcgctttacatagccatccttatcggtaatggaagcaatcaccgtgaccatatccgaaccattggcacgcaggggcagtccagaatcaacagtcagtacaagctgttcattacgtttggaaggcatattcttggtcctagcaacaatcttgccatccaggaatccctcagccacaatactacattgttccggtttcccggcccgatgaagtgcccggacatccacaaagctataagcacccttaaaaacaacgggaggatgacgaatccccttctcctccagcaacggcacttgcacaagggtgtctttttcgttcacaatgacacgtacactatcacagttggtataaaccactatatcctcgggggaaaaaggagtcatggcattagctatatacaccatcggcccactatcagcctgctccaagtgcaggtgcggatcacgctggctcatcatcatgtaataggaatactttggctgacggaacatatccatcagtcctccccagaaagggtcaggatgataaccacgctggtggtcaaacgaatgccacaaggcacctcctatatgcccccgaggagatttgcagaactgatcaaccgtaagagagccgccataatccttgcgggcatagtgctgggcctggcgaatctgtggctcttcaccccattcacgtgccacacggctgtaagaattgtgggaattccagtcatccacacagtcaccatactcccgggtaaagcaggatttgcctgcattccggtaaaacgcctcgttcttgggggctgtataaactacatcatatcccattgctcctttgctcttgtcatcaatggcagcatagcaacccggagccggatactcttcatgagtagcccgataggcattctgtgcgaaagactccggaaaagccgtctcattaagtaccggttcccacagaaggacagacggatgattacggtctcgacggaccatattacggatgtcggaaaggatacgttcttcaaacaccggttccggattccagtactgccagccgggagtggctacaataatgaacatgcccagttcatcgcaggcatccataaatgcagggtcttggggatagtgtgccgagcgtataatccggaaaccagcatcacgcattttcttcacgtccagccaatgcaggttgttgggtacggcattcccgatataagcatagtcctgatggcggtttacccccatcagcttgtctccgaacggcttaccgttgatatagagaccgtcggcaccgcgaaactcaatgcttcggataccgatacgggaaacaacagcgtcgcacagcttgccgttaagatagacagaggtgcggagccgatacagattcggagtatcgggatgccacaaagacggatttctgacagtgagctgctgcatgacgtgtccatcacttccggcagacaagctgagacttttccttgtactggccacctgcttgccaacagcatccagcagggttgactccactaccacccggcaaccactctctctatcattgacgatatgagtcttgacattcacccgagccttttggtccgacacatcctcatagctgacaaacacgcctcccccagccacctggccagcctcattggcatcgcttacatgcacgtcaccggtacagataagataacaatcacggtagatgccaccaaatacacaaaaatccatcgtatactgtttgcgccccggcgggaaagaagggtcatcactgttatcagcacatacggcaacggttacctcatcacctggacgcacaccaacagcagtcaaatctatactcaccgggagaaaaccaccgaagtgctcctttactttgtaaccattgatataaaagctgcttttacccataaccgcctcaaaatagagggacaaccgcttaccttgataccgagtatcgacagtgaaacgcttggaataccaggccggcccctgataattgcgagaaccgctcgcctcggaaggaaccagctgtacggtatgcggtaggtttaccagctcccacttgctgtcatccagttgcaaaggatcagcttttaaaggaatatccccccgatgaaaacgccatccgggattaaagtccaatacctcgcggccggaattgggcaccggataaaaactggcagcagaaaagtgttcttgtgcttgcagtacaccgatgcaagcccagaaaataattaataaaagaatctttttcataatctatatcattgatttgtcattctatccacacgtattaccgccggttttccacaaagcatcccctgcggcataggtactttgatttcccttccattgagaacaatccgaatccctttcagagccgcattcatgcaagcatcggtgacagaaaccacaatctcccctgcttcttcccttatcagcaccgcacacggggcagaagcggaaagagacaaaccttctgcctgcaaacctttattgccgggatacaagacagcttccaccacctttccatccatagagcagaccgcctgcaccagggtatcgttctgcaatacccggaacggcagttcatccgacggtatctgccggcctgcataaaccacatagccataggtatcatcaaccggacgctgtccatgatttgcccacagacggaggattctggcttctgagggcaagccttgtttcttttcattcaccttgttccgcttcacccaatctgtgggacgagtctcgcaagtaacaaatgcttcacgggtatactcaggaagtatccgataggcaaacttacctttctgcaccagccagaggggagtaccatctgccgacaaaagcgagtgagtgccggaagcgacaagctccatttttccccttttcatcgagaaaacttcatccgtccaagccgtctggtcgatggtggtgcgaatctccccatccagttcaggacgcttattggttacgcccgcacccaaagctaccatgtaatctcccagaatgaaataagacttatatgccttgaagccataaagaacctcgttcaaaccctcactgttccccttgtcgttcacaccctctttcgcagaagcgttcatcttttcgaagatatatcctgcaacggcattactcccgccatccgtagcaccggcagcaaaattactcctgctgcaataaccacgccaattctctacgggaaccagtttgtccatgccttcgcgtgcagtcacacccggggaagcggtgacatcccaaccgcccataatccggaaatactcatcgccgctgcgctggaacaacgtcattccatccgtcggatagaaattgtaggcatcagcaaaactggcggcactctccagtccgtcacaacggacagaggccatattaatcgtgatatgatagtcgggggtcttctttatcaagtcgtcgttgttgaagaaccaacgggtaccggaatagatgcccggagcatactcctccatcatgatgcgattcttcttcacctcttgctgcaattgcaacagttcccgctgctcttcgggggtgaaagagtccatccagttgccgataaggttatccagcattccggcataagggatggaaagctctgtggaattatatacatacgagccacggtccaggcaaggaaggcgatatcccttataataataccaggcaccaccacgcaggaaattaagaagtgcctgcacattattccggcccagattcttggcccagggagagcctttcagcatattcagcattttaagtgcattggaagtcccgtcaatgggatagccccaaatcaggcattgctttccatgtccccaacctgccccgtcggcagtgaatccctcagtccaaaaagcatcggaatacgtagtttgggaggtcatactgataccgcgctggcaaacttccgccagcaagtctatcataggaatggaacggtacatggcggccacgggcaatagggaacgataggccaatgcattgccgcccacccaccacacatggttgcggaaacgggaaatggaaactacattctcatcggtttcgtcgtggcggagaggttgggtccaagcttgtaaggcaatggttttcaacatatcgcacgcctcttgcagcaatgtgccgcctttcccaccttcagcatcgtccatctgtttcagatagcagaaataagtattgaccgctgccgtaggtatggcaaagcaagatgcatggaaacggggaccgtcattggggcgtcctgcctcgataccgccgtaatgcaagattgccttcagcactttaccggacaaggcctgctcttctgtcagttcacctttacgataggcatccgctactttccagatacggttgaaggcatccgccacgaacaagcctatttcggcctgcgggttggagtaaggcttctgaaaggcattctctttgcggaattgctcttcctgctcccttaaaccagaaaagataccgtcggcagtgagttgtgccagacactcctgcgcactcaaccgggtgtccagggaatgataacggtaaggatgctgcgcaaaggaagcgcggaaagccttgatggacttctccttctctgcatccccccgctgccgggcttcgttgtagtaacggtgataattattgaaagcaaactgcgtttccttctcctgcggaaaagcggttgcggccaagcaaaggccgagaatggtcagaataaggtttctctgcatattagaatcgtattggttattgtataatgtccgattatattttcagcaaatataatgaaaggcagagggaagaaatgacggcaatcatacaaaacagatgcagttttcgtacggaactggctgagtgcggcaacaggcataaaaagattggctatctttgtttcatcataataaccttattaacaacactccccatgaaaagacatcatctgctttttctctttgccgctttcatagctataacgtcttctgcccagaagctggacaatctggtagaactgaaacagaagtcggaaaacccactgtttcatcacttggacaaagctccacgtacaccagctttcgagtgcgaaggctattgggcctggggaagttcggtagtgaaaggagatgacggcaagtaccatatgttcgtttcccgctttcccaaaagcttgccgttccatccgggatggatggtagcctcggagattgtacatgccgtatccgagataccgcagggaccttatcggttcagcgaagtggccctccctgcccgtggtgcgcaatactgggacggacgctccacacacaatccacgcattttgaggcagaacgggaaatactaccttatctatatgggttccacccacccctttgccgaccctacttacgaacaactcaccctgaaaagcccctggtgtaccgttgcccgcgccaacaaacgcgtgggactggccgttgccgactcgccctacggtccgtggaaacgcttggacgagcccatcttgaagaccaagcccaatactttctacagttttctgacctcaaatccctcgcctatcattcaagaagacggttcggtgatgatgatattcaaggggcgacattacacgaacggttacctgcactcggccatgagcctcggaatggcttatgctcctaccatagaaggcccttatcgagtgctgaacaatgactgtcccatctttgaagtagacggtcagggcgaagcggaagaccctttcctctggaaagatgcagacggctatcatgccatcttcaaagaccatgtagccaagtttaccggcgaacggggcggaggcgtcatggcacattccaaagacggcatccaatggacggtggacaaagacccgaaagcctactcgctcactgtggagtgggaagacggcagcgtggagaagcaaggacaactggaacgccccttcatcctcttcgaggacggaaagcctgcctacatcttctttgccacgatggacgggcccggaggattcgaaaatgcatcccgttcttggaatatggtgattcccatcaaagatcggaagtaaaaatgtgtatctttgcagccatgaacgagaacatattacccatccacttcgccccgctgcaaggctacaccgatgccgtctaccggcgggcgcatgcacgcatattcggcggcatagagacctattactctcctttcgtacgcatggagcacggagaaatccggcggaaagatgcccgtgacattgagccggacaacaacccggacctgcacctcatcccccagctcattgctccggatgcggacaagctggagcacataatgtcccttttcatcgaaaaaggataccaggaagcggacatcaatctgggttgtccttttccgatgctggcccggcgccacaatggctgcggcatgctgccctatcccgaagaagtgaaggcgctgctctccgaagccatcgaccgacatcccgacatccgtttctccgtgaagctgcgtctgggctgggagcaggcagaggagtgtcttgccctgctaccgctgttcaacgaactccccctcgcacacatcatcctgcacccgcgtctgggcaagcagcaatacaaaggagaggtagacctggagggatttgaagctttctacaaagagtgcacccaccctctgttctacaacggagacctgcataccgcgaatgatatccgttctatcaccacacggttcccccgattggcaggtatcgtcatcggccgcgggctactcgccaatcctgccctggcgctggaatacaagcaaggaaccccgatttctcccgatgaaatggcgaaaaaagtgggacaactacacaccgaggtcttcaacgcctatcaagagctactgcaaggcggtgaggcacagctattaatgaaaatgaaaagtttctgggagtacctattgccggacggagaccgcaaagcgagaaagaccattcataagaccagcaaactggcaaactatcagtcagcagtaagcaatctgctcggaacatattaaacaaccgtttccagtatctttctctataggagagaaaggctaagactcctataccgaatacccacaacacccggatgtattcacccaaaacatggggatgtattaccccaaaacatccccatgttttatagcacaacacccggatgttatggggtaaaacatccgggtgttgtgggtattcagtatcaatgtctaacctatactctccctacctctttagctctacctctaagcttgcagcatcccggcaagtaaagcgcagcacagtctgattcttgtctgccgacaacaccttgcaataggacgtctcggcaaccttccactgtcccttcaaagtaacggttacgggaatctcctgactctcattgtcagtccacgggcgtgaatagatactgcgctcaatacgttttccgtccttatcgaaagcctcgtcactcggaccacgatacaaggccaggtcgggctgggaaacagtcagcagaagcttgtccttatattcgcgtatcatgacaaggcacgatgtatcggctttctgcaacaatccaccgtcgggcagagcctgcggagtctcaaacaagacgtaagaagtaagactgtctgccggagaacgcacaatgtgggcgttgcggtcttgccggagaatcttgtaagtgggtttcttggcgaatgccttcaaagcggcggcatccgtgtggggcagcactgcatattcgtaggaagcgcctttcggggctttgccatgttgcaatgtcaaggacacccagtcgccggaagtaggcttggtgctacgctcgcctacggtcacttgcgggaagttcttctcatatcgggcagtaggacgggaagctttggaaatgtaataacctatgccgttggggtctatataagtctgtccatcactctgataggactcccagtaccggcgggtttcgggagtggtggcggcaagctggaacacggtggtttccgttggatattcggtatttaggttttcgatgtccgtaccgaggcatacaatggtgccgtcgaagaaatggaacgacttgcgggcacggtgagaaccgttatacttatcatgttcatgcagcaccataccgaagttaccgttcagatgtgcttgggacaaaccgccggcaaaagcttcgtcggaatagagcatctcctccatgccggagaaggtatcgacattcaatacccgggcacgcagctggtcgaaaggcaaatgaatgctcgtgacacccggaatacgattccagtcgaaaccggcctcctgccagccactggtggcaaaagtaaccatttcatcgggttttccggtaagaatctgcatgctgccatgtgccagataacggccatagaagttggcggggagatagtgctcggcagcccagaggtaacgggaatgtccgcgtactacggcagcccagttgctgcgacgctgtacggatacacaaccgtaacccaaagccagattgccttgcgggtcgggttccggacggaagccttgggcttcgagcaacttcttcatctccaattcgtggcaggtagaagccttcggcagatagtcgggcgcattcttgtccggagcttctgtataggcaaccaggcgcagataggcagcagccatttcggggtcatacttctgcttgccatccggcgtaccggcaatggccatcgtggcatattggataggtatcaggcttcctcccccgttgggatggcgtccggacatggagagagaccattgcttcagattgcaatagaaacgcatggtgagaagcactttcttcaccgtctcgtgtgcctgctcggacagacggaactcggtaccactcagcaagtaaatcatattagtggcaccgtccagaccgcccactgcataggcaggataattgttgcaatgatggaagcaagcaccgtccggcttgaaagaaccggccaatcccggcgcaggaaggcagcctttgtccagccaacgggagaaggaacgcaggtattgcagtttctccggtgtatcctccataatcagaatgctggctatgcggccttgcaacttggtgttgaacgtatctatatcaataccgttgacggcaggttcgggatatacctcattggtgatggcataccagttgagcgtacgtaccgcctcttccagcttacctgcctcacgcaacacgtccttcatcaagaaataagccacaaacagaccgcgcatactatatccgtaatggtggatattcccccagcaactgccataggcaataccctggtcggtggcattgtcgtacatggcgatgaatttctgctccaactcgtgtttcagcgccgcatcctccgcattgttgtaggcgatggcgacgcgtttcatcaggttgaaatagtcgcttatctctatccccagtctggagaacatatctttgtcccaatcgggtaccatacgttcgtatgcctcggagtgacgtacgaaatagataggacgtcctgccaccttgccgttcttgtaggtaatccgataaaaatcatacttctcacggatggactgcatctccttgtccgaaagtgcggaaggcgtgtagagcatgttgcggaaacgcttctccataatccgtatatcctgcttctgcgcctcggtcacgtctgtcaaaggaatgtccggtttccacaaggagtgttcgtagataaccagccagtggttggtggttcccttatttacaaacggtacctgcaagtcggcagtctgctggcgggcatccaccttgctggcagtaatcagatggtcgaaaaagagtttccctttcacatcaggggctacaatgcggatttcgtccatcccttcttccggggtgccttgcatatcgcgttcataacatacccatgctccgcgccaaccggtgaagttgatgccaaaaggaaaagaggtgcataccttgccgtccttcaggaactcgaaccgaatctgcttgtcctgggcctgctcattgtacacccatacgatgaaagccgaaagataggtgtctttccccgtcgggtctttcttctcaaacttcaagtcttttttgatagacagtgcggcacccggctcgaaagtccagctcaaactgtggtcaccatccctataatgttcgtcgctaatgcccaactgcgaaccagctgccgtagtgacaaacgccggaacctgcttctcctcaaaagaaagcaagcgctcattcttcacgatttgtgcatgtacactgcccggcagcaacatgcaaacgagcgctaccgctcctattttccatttactgaattgcatcatgtctgtttatttaaggttatcgatatttgctacttggaaatctgcaaaacgtacgtggttctgccacaaccgtaaggcgaaatagccgtctcctttgccatcggcaaccggtaagctgaaaagctcttcaccatccatggcataagtggtggctccattctccacacggattttaacttcataccaatggttgggcttcaaaaggtgggcggcatcggtatactctttcaagatgggtttaatctttgcatcgtccactccataatactctccatggtattcacggaaacgcgtagttccattatcattaccgccgtagcccacatagtaaaggtccagcgtattgtaattcttgaactcgccgttgcgccatgcactgcgggcaaagaagtcatccggatgccgggggtcatcggccccccaaaaacaattcaagtcgctgagacggtcgtagctaccattctcaaccaccacttgtacccggtaggtaatctcatagtttcccgtcaaccgttccttataccaaagggacagcccgtccggagatacaatatccatcgtatcgccgatacatgtaatttccacttttccggaagaatcctccacgacccaggcggtaagccggcaggaagcgcccatctccataccggggaggacacataagagaagttgcatcaaaagaagttgtaaccgcatatttcaatgtattagtacggtacaaagaaacccctctttttggaaaaagaggggcataaatcgtacagaagaaggataaaataatgattgaggcggatttctgcccccacttcatcaaggatgaagttcttcgaaagccttgttttcctcttgtaccgcctgaatagtttcttccagttcattgatagggagatcgaagttgtaccagtcgttatagcagtcggtgacataccacttgccatccgtcagttcaaagaccacacgaagggaaggttctgattcatcatagcctgcttcgaactctttatgggcaggctcattgacagtgaagtgagaaatataggtacctccctcctcttcggtagtacgtccttccttcagcgtttcttcgtctagcaatgcccacttctcgcgggtgaagggaaaagtctgttccgtctcaccgtcatccttcaagagggcgatgggagacttcaaaggaaacttgattcgggaatactggaatgaagcactggacgtgaatttctggagaaatgtcttgaaatcctcctcttcggcagccagaccattgagagtcgtcagcatgagtgccgcaaacagacaaaaaacaaagcggatagccttcatatactcggattatttttcaatgcgcaaagataatataaaagtaataaaatgctaaggctatggggcgataattattatcatctatgtttcagatactcgtaaccaaaccggcaacgcaagcagtctttcttgtcacaatattccttttgaagttgaagcagagcctgcgaatcggcagcggtagataccggcaaaccggcaccatcccaaagtcgggttacgtgattgttttcggccttcaaggattcaaggaaacgggtggcacggtcacacaaaacgtcatcggccttgtgcaggccataagcataaagaaacgggatgaccgtattgatggcaatcagattcaaggcgccatcccctacccgcttttccctccggggtgaaacctttctgaagttgaagtgctcctcccaatacgcggaagtcctggctgtcagtatcttcttcaccgcttccagcgtttccgcctccatgacacgcgagaagagtgcctgctccttgtgatacagacaggcaagctgggccaggcgtacatgtggaaagttatcgggacgaagacgcagaaaccgccactgctcaacagacatgggagctggcagctcgaacttgtgttgcaggtagcggaactctttctgaagtatcaaataataatcatctgcctctgccgagacctcctccagcaggcctgcctgccccaggaagaaagcctccacttgaaacagactgtcccgatgcttgtctacggcgcggaatggaaggcggtttgcccatgcctcgaaagcatccccattcagcccgaagccgaagttacgagcaagagtaatgaagaaaacatcttcccaatgatgattgcagcgttcgagccgctgggatatgacgcatgctttctgctcaaaacgctctacctgcaaagcggacagccaggaatggacggtcagctttgggagggaggcaaggatggaatagcagggaggataaatctctgtctgccgaagctcttcatagcgcaagcggacagtgtcggggcaagtgagcaccatctggggaaccagctcaccgttcgtgcggtacacatcacaattcgattcgcccaccacgtgcaggatgacggtatcatacgccttgtcacggtcgtgcctatggagcagccagtctgatgcctgcgtatgcacttcgacgttgcccacccagagcgtaccgtctattttcagtttggcattaaaaaaatcggggcctgcattcatgttcggcaaaccgggatctatcacttctaccggccggccggaggttgtctggagcaatgacaaaggaaatattttgtgcttccaaacataatgcagtagttgttccatgttaacaagacgttaatgttgagcacaaatgtaagaaaaagattatctttgcgacctatagtttgttgataaactaaataaaaacagatagaaacaatgaaaatcgcattaatcggctacggaaaaatgggcaaggaaatcgagaaaatagcccttggccgcggacacgaaattgtaagcatcatcgatgtcgacaatcaggaagactttgaatcggcagccttcaagagcgccgacgttgccatagagttcaccaaccccatggttgcatacaataactatatgaaggcattccgcgccggggtcaaactggtatccggcagtacgggctggatggcggaacatggagacgaagtgaagagactttgtaccgaaggcggcaagacactgttctggtcgtccaacttcagtctgggagtaagcatattctctgccgtcaacaagtacctcgcaaagataatgaaccaattccctgcctatgatgtgacaatgagcgaaacgcaccacatccacaagatggacgctccgagcggaacggccatcacgcttgccgaaggtattctggagaatctcgaccgtaaggacaaatggatagaaggaactttccaggctcccgacggaaccgtttcgggctctacggaatgtgcagccaatgagctacccataagttctatccgcgaaggagaagtaccgggcatccacagcatccgctacgactccgaagccgacagcatcactatcacccacgatgccaagaatcgcaggggatttgccttgggagctgtccttgctgccgaatataccgccaagcacgaaggtgctttgggaatgagtgacttgtttccatttttaaaagactaaaacatcatgagaaaagcaacacgcacccaatggattaaattcagtatagtcaccttgctctaccttgcctttctggtttgggtaaaaagctggctgggactgattgtactacccttcatttttgacatctacatcagtaagaagataccctgggggttctggaagaaatcggagaatcctgccgtacgcagcatcatgagttgggtggatgccatcgtatttgcgctggtagccgtctacttcgtaaatatctatgtgttccagaattaccagataccgtcttcctcactggagaaatccttgttggtaggcgatttcctttatgtcagcaagatgagctatggcccgcgcgtaccaaatacaccgctttccatgccgttagcacaacatacgctgccggtgttcaacactaaatcgtacatcgaatggccccaatgggaatacaaacgtgtgccgggcttcggcaaagtgaaactgaacgatattgtggtgttcaacttcccggcaggcgacacggtagccaccaatttccagcagacagacttctatacccttgcttatgaagaaggaaaacgcgtgtatcccaacaaagtgaatatggacagtttgacacgcaaacaacaacgtaccgtctatgatttgtactacaatgccggacgtaacctcatccgttccaatccgagaatgtacggtgacattgtcatacgccccgtcgaccgtcgtgaaaattatgtaaaacgttgcgtaggcctgcccagcgatacattgcaaatcaagaaaggacaagtatacatcgacggcaaagccatcgagaaccctacagaaatgcagttcaactactttgtacagacaacggggccctatatcaccgatgatatgttccgtgaactgggcatcagcaaagaagaccagacactgatgaccgacggcctgggctgggaagagaatctgattgaaatgggattggaccgccgggatgcccaaggaagactggcaccggtctatcatcttccgcttacccaaaagatgtacgagaccctttcgggcaacaagaaactcatcagtaatattatcatcgaaccgggagagttctcgggacagatgtatccgctgaacctttacaccaaatgggaccgcaataactacggtccaatctggattcccgccaaaggtgccaccatcaagctgaccgaggataacctgcccatctacgaacgctgcatcgttgcctatgaaggcaacaaactggaagtcaaggaagacggcatctacatcaacggtgaaaagaccgactcctatactttcaatatggattactactggatgatgggcgacaaccgcgacaagtcggccgactcccgatactggggttttgtgccggaggaccatgtcgtaggaaagcctatcgtagtatggttgtcactggacaaagaccgaggctggtttgacggtaagatacgctggaaccggatattcaagtgggtggacggcattaaatgaaaaaaggatggaagatagcaattacaatagttggagtggcactcgtcgtggtgctgcttcggggttgtgtggcaacttcctatcttatcccctcttccggcatggaaaattcactgtaccaaggtgagcgtattcttgtggacaagtggagctatggcctgcgactacctttcatgaagttatgggggtatcatcgttgggcagacagtcccgtacctaaagaggatattctagtattcaacaatcctgccaatctttcagaacctacgattgaccggcgggaggtctttatcagccgttgcatcggtactcccggagataccttgttgatagattcactcttttctgtgattccttccgagaagaatgcacccgaccagaagttcctttattcctatcccaggcaacgggaacggcagctggattcattactgtccatcctttccatcgctcccaacaaactattggggcaggattcaacaaagaatatacgcagtttcagccgttatgaacactacttgctggaacaagccatgaacggaaagtgctggatagaacctattgtcaaggaagattctatggagatgctgaaacctctgataatccccagcaaaggcaaagccgtgcgcgtatatccgtggaacaagactttgttgcgaaataccctggtacttcacgaaaagaaacaagccgaaatcaaaaacgacaccctttatgtagaaggcaaacccgtgcaacactgccattttaccaaagactactactgggtaagtgccaacaataccatcaatctttcggactcccgtcttttcggtttcgtccccgaagaccacatcataggcaaggcatctatcatctggttctccaaagaaaagggaacaggacctttcagcggttaccgatggggcaggatatggaaaagagtggaatgacaaacaaatgaaagaataaaaatgaaaatacaaacaatgaacagtaacttcaatcgtaaatcgcaaatcatctaatcgtaaatatactgatgaaaacagtttttctttcttccgcctatttggctcccatagaatattataccaaattgctggcatacgataaagtattcatcgaacagcatgaccactatatgaagcagacttaccgcaaccgctgcaccattgccgcaccggacggcgagttggcactttccatccctaccgtaaagccggatagcctaaaatgcccgatgcgcgatatccgtatctccgaccacggtaactggcggcatctgcactggaatgcgcttgaatctgcctacaaccacactcctttctttgaatattataaagacgacttccgccctttctatgaaaagaagtatgagtttttagtcgatttcaacgaagaactttgccatcttatctgttctctgatagacatacagcccgatatggcacgcaccaccgaataccggactgaattcactccgaatgaagcggatttccgcgaacgcatccatccgaagaaagacttccgactgaaagacccggagttctctcccaaaccctattaccaggtctttcaggagaagcacggctttctgcctaacctgagcattgtagatttgctgttcaatatggggccggagagtttgttgatgttgtaggttacttatgggaattagggagttcatttctaaacgggtttgagataaatgttagtatcacgaggggacaagttgacaaggcaacaagcgccttgcggtatatcatttacttcatttctgccccgttatgaaccgggaaaagagccgaatagcaatctgcattatttacaaacaacacagattcaagaaacagtagcatactgaacctaattcagtcgtatagtgaatagggctcagtcgtatagtgaatgcagcacaccagaataatgctgataatcaagaagttgcaaaaacacagtcagaaccttgataaattacaacaaattatcaaaatatcattgtgctcatttcgtagcgggattgaacacagaggtacgaagtatccacctcccctttaggggattcggggagtattcaacccctgcttcgcatcacttattgaacctctgcaagaactccgccaggttctccctttcttccaggcccagctttttccgaaggcgataacggctgatttccactccgcgcagagagatgttcagcaagggagctatctctttggagagcaggttcatcttgatatatgcacagagcagtttatccttgttgttcaattcgggatatgcctcttcgagttttctgaagaagtcgtggtagacagagtcaaaggtgctttggaaagcctgcaagtcgtcatcgtgctcaatattcgtttcaatctgtcccagtagccgaagtgttttacgccggagggaaaccaagttttcttcactgatggaatgggaaatgcctaatacttctttcttgatacccatcagcatctcattcttgcgcacaatattcaaggtagtacggattagttcttctgatttatggcttaactctgcctgcaagttctcctctttcagtgagtcaatcttctggtctttcaattcactctctttcttgaattcttgtttctgcctgtagagctccagctctttttgcatcaacagatgcttccggctgacagctatgcgataggctatataatatagtagtaaacccacagcgactgcatatatcaggtagctccaccaggtgcgataccaaggaggcaagatttcaaatgagaacgaagtcattaccaactcctggcctttatcggtcatcaattttacgctaaacacatacttaccttcatgcagacccgtaaattctttaatagtattctcactgtactcgctccattctcccctttcgctcccctcgctcaagcgataggaaaaaagagccgattgggatgcatcgttactgttcacattatactctatgcggagggagttgtgtttatagggaatagtgacaagagaatctgtgtaatgatagctacgcccgtaaatcaatgagtcgcgtcgtcctgtgagatatacacggcgtatctgtagagatagcttttccttacccacagccgtcgatgaaaagcgtaccagggaaaaaccttcttccgttcccaccacagcttgcccgtcatatacatttacatgctcatagttctctatcaaagagcccttcaagaatgtatcatgaggcaattttgaataggtattcttcacagcatcgtagcgcaacaacttgagagcttcacctgaaacgtaccatatattatgggccatatccatggtgagataactgtaagcggctttcccgtccaacatattttccaactcatgatattcttccagactatccgtggcttgattgtagcgccataacccgtaatgtgacactgcaactgtttcactgtttacctgcgtcagaaatatatcataaccggaagggaaagcgctatggttatactttttcaaacttaccacttcctgcaaatcatccgacagaatcaagcggcagacacctctgtccttatttgtcacccataacgcattacccgagctttcagccattaggctttttgcagcataagtgaaattcttaagccggaaagcaggctgccaacgcccggccacttttttcagtaaatgcaacccactatatttaccataagtacccgcaatcagcacatccgggcgaccgttcaaagggacaaggctcctgacaccttttataccatccaaatgctccatcttatcgccgtctatcacaaagacaccgttgtccgaagcacagaacagcttaccgtcatagtttaggaaagaccacatctgtccaccggttccgggaacaaaagtcatcggtatctctttgttcagttcagtggatggtagtgttgtataaaggccctgattggaagccagatacaacttaccctgataaacgatagaagaatatccggacccaatgaccggtttattaccatatagagaagaaacgggcgaactcaaatgtacacagtcaatgccattatccagccccaaccaaaggttgttctgcgcatcgaaagacatactgagcactgttttgttctgcaatccactattaatggaaatcacattcatttcatccttttccaaatcaagcaaacaaaccccatcctgcacagagccaagtgccagcaaagactggttaagagcagcacaaaacacacgattgtgctgcataaagctatctgcaacactattgaacttctgcaccgtctcgccatcatagataaaaaggccgttgtaacgggtggctatcagaatcttgccactatagggtaatagtcccgataccctgcccagcatctccgaacccggcaccaaactgaacttctttccatccatcaccagaactccctcggccgcaccgatatagaacttattatataaaatggccgaagtataaatctcacccggatactccaagtattccaacttattattttcccagtagaacaaactacggtctgattggaaatagattctctctttatcctgcaatatgttccatatcacgccaactattgaattcgggggcaaattgtccgaaaggcatgtatagtccaatccgcccagcctgtttggagtgaaataaccgaaccgcccgattccaccgatataaatccgtccgtcattccctattctcatggcccgcgcctttgcattacgtatagggtaaagattccagcttgcaccgtcaaattcgagtaaaccgttactattggccacatacatccaaccgttatcgtgttgctgtaacatccagttttgattacctgccttataagtatggcgggtatagttcgttaccgggcgttgccatcctgcattcaactgcaccgacagcgataacaaaagggtaagtataaaataggacttgcttttcatagcggtcaacatttgcgtttatgaagcaaagataactcctttactctaaagtagtattccaccacatcatctttaacagatttactcagaagaagcatacttgaaagaaaacgtacttataaccaacaccttacaacattcgtgagaaagtaatgatgtagtcaaaaccggcatttgatgtaattatgatgtagccgacttcggaatacgaatgcctcatacctgtatatttgccatcactctacagaagaatgcatggaaatcgttcttcttaattttaaatcaaaatatagtagtatgaaaacactcttgaagaacagtctgacttttcttttgatgctgatgccggtattagctttcgcccagcaagcacctcagataatgaatgtcagcgcacgccagaagacatccctcgacgggcagtggaaaacaattgtagatccttttgaaaacggctactacgattaccgtctgaaaccctatgccggaggttatgcccaggacaagacttattccgacaagaccaagttgcaggaatacgactttgaaacggataaactgctgtttgttcccggagactggaacacacagcgtccgcaattgtattattatgaaggaaccgtatggtaccgcaaacattttgaatactccttgcagccgggcaagcgccttttcctgaacttcggagctgttaattacgaggctatcgtgtggctgaacggcaaacgtctgggaaggcacatcggcgggtttactcctttcaactttgaaattaccaacctcctgaaagaaggcacgaacagcctcgtggtcaaggtggacaacaaacgcctgcccgaagctgtgcccacggtcaatgcagattggtggaacttcggtggaataacccgtcccgtcactctgatagaaatgcctgcaacctatatacgcgactattacgtacagttggcaaaggatgacaagaacatgattgagggctgggtgcaactggaaggttctggcaaggaacagaagataacactggatattcccgaactgaaagtaaagaaagaagtcacgaccgatgccaacgggtatgcttcattcctaataaaaagcaaacctatactctggactccggagaatccgaaattatatgccgtgaacctggcttccgaaacggataaggtttctgatgagataggtttccgcacgattcgcacggagggcaccaagatattgctgaatgacaaggaaatcttctgcaggggtatcagcatccacgaagaaactccctattacagtggtcgtgcttactcaaaagaccatgcccacacattgctgagttgggcaaaggaactgggatgcaactttgttcgcctggcccattatccccataatgaagagatggtgcgcgaggccgaacgtatgggcttccttgtatggtccgaaattcccgtgtattggacgattcactgggagaacaaggatacttaccaaaatgcggagcaacaattgtgcgacatgattgcccgcgacaagaaccgttgtaacatcatcatctggtctattgccaacgaaactccgcacagcgagacgcgtctcacgttcctctctaatctggcaaacaaagcaagaagcctcgatagcgtccgcctgattggcgcagctatggagaaggaagaagtacagccgggtgttctgacggtaaacgacccgttgggagagctattggatatcatcagcttcaacgagtatgtgggctggtacgatggcgactctgagaaatgtgaccgtgtgaactggacattcgatactcagaaaccggtattcatcagtgaattcggaggcggtgctttgtacgggcgccacggctcacccaaagaacgcttcacggaggagtatcaggaggatttgtatatccgccacgtaaacatgttgaaacgtattccgggacttgccggcactactccgtggatattgaaagatttccgctcaccgcgccgccatgtacccgagattcaagacgacttcaaccgtaaaggactggtttctgacaaaggacagaaaaagaaagcattctttgttttgcagaaatggtataaagaattaaccgaagcatataaatagctcacaacaagacctcattaataactttaaaaaagaaaggacgcctatgaagtaacacctatgagaacacactttctttataggaagcagctcaactgttttctgtagagagaaagaagatgaaggttatcatcttcacatgaaaattaacctttaatttattcattcaaaattaagtctaatatgaaacattttttggtactcctattactctttattggtatcggaagtgtcacggcacaaaatgccagaattaccggtacagtaaaagataacacaggagaggcggttatcggtgctaatataaaagtaaaagacagcaccggcggcacaatcacagacatcgacggacattttaacattgaagcctcatctaatgcaactcttgtagtatctttcatcggatacattactcaagaagtacccttgaaaggtagaaccaatgtagtagtaaccctctcggaagactctcaaacactggatgaggtcgttgtagtgggttatggaactcagaagaaagtaaacctgaccggttctgttgcagcagtaaaagtcgatgaaaagattgccagccgttccatcacaaacgtatcttccagtctctcgggtttggtgccgggattggtagtgagccaaacaaccggttttgcaggtggagacggtgcttcgctgaaagtacgcggtttgggttccatcaacaattctgacccattgattgtagtggacgggatgccggatgtagatatcaatcgtattaatatgaacgatattgaaagcatctcagtcttaaaagatgcagcttcgtcagccgtttacggttcgcgtgcagccaacggtgttatcttgattaccaccaaaggcggttctaaagaagccaaatccaaagtgacttataatggttcttatgccttatcaagcctcgtagagttttacgactatttagccgactatagccgtgcactgactatgcagatgcgctctgctgccacaggtaacaaatcgaccagtttccagcagggtacggtagagcaatggatggccatgggcttggtagatcctattctttttccgaacaccgaccaatatgacgaaatgttccgtaccggtgccatcatgaaccatacggtttcagcctccggcggcaacgataagataaatttctatacttcactcggcatcatggaccaggaaggtctgcaaatccataatgactacaaccgttataacatgcgtttgaacgtggattataaggttcgtgataacgtaaaaataggtatcagaacagatggtagctggtcagagcgccagacacctcgcggcgcaggtttggaaactgcaggtttaaaatatgtcatctccggtattttgaacaagcatcctgaaacaggtgaatacggcggtgccatggcttatggagaatctgcttctgccggtaatgctgttgccgaatacgaagcttatcgcacaaatacttcccacaaagaatttaatggaaacgcttacttggaatgggaaccgcttaaggatttgaagttgaacgtcagttacgctttgcgctattataaccagttcagcaaaagcatccagaatgtggtgaaccagatgaacttccagaccaacagtatagcccgcaccatgccggatacaggtgatatcatcagcaattccaataacgaaggtcataagactttgttccaaggacgtatcacttatgaaaaggaaatcttcaaagggcatcatatttccgccatgttcaatgcagccgaagaatactggttccaacgcaacatgggtgcaggacgtaagaaccgtttgcacaacagccttgaagaactggatgcagcttccaaggaagtacagaccaacgacggtaaatccgaatccgaaggtttgcgttctttcatagggcgcgtcaactatacattatttgataaatacttgtttgaattcaacttccgttccgacggttcttcccgctttgccaaaggacaccaatggggtttcttcccatcagctgctgtaggctggcgtgtttcggaagaagccttcttcgccccgttgaagaaagcaatcagtaatgccaagttccgtgcttcttacggttctctgggtaataactccggagtaggacgttacgaacagaaagagacaatgggaactaccaattatattgttggaaacaacggtcttgcaaccggattcagcgccaataagatgattaaccaagacctgtcctgggaagaaacccgtgtcatcaatataggtttggacttagggttcttcaacaaccggctgactgccgaactcgactggtacgaccgtttcaccaccggtatgattcgtggttccagcatatcttcgttattaaccggttattcggcaccgaatatcaatgtggccgacctgcgtaaccgcggtgttgaagtgaatctgaactggcagtccagtattcgcaaattcgaatacagcgtcaatgtaaacgcttcttataacgtaaataagctggagaaatggggtgactatctgaaccgtgggtggattatgctcgacatgccttaccacttcctctatatatatgaagcttatccgggtttggtgcaaagctggaatcaactctacaatgcaccctatcaaggagatgcctacaacgcaccgggtgacattatcctcaaagacttgaatggtgacggtaaaatcagtgaccttgataagaaagcatacaccgacaaataccgcgataccccgatgggacaattcggtattactttgaccggagcctaccaaggttttgatatccaggctttgttccagggtaactacgggcgttccgatgtatggttggatgatttgaacaataccaagataccggataaccgttatgcattccagcaattccattggagtgattcttggtcgttagacaatcgtggtgcctccctaccccgtctgctgaatggtagcggcggtaacaagaaccgtgaagaaagtacgtattgggcttataataccaactatttccgtttgaagaacttacaggttggttataccgttcccgaacgttatatgcagagaatcggtttcaaccgtgcacgtatctacttatccggtgagaacctctttactttaactccctggaaaggtatcgaccctgaaaagcctcatgggaacgacctatacccattggttaaaacctactcaatcggtttgaatatagaattctgataactcaacaaataagaaagaatatgaaatatattaagtatatagcattagccggactggtcggtttaacatcttcttgtatagatgacctgctgaaccgtcctgctacaacagaagtatcttcggacctcttttggacaagtacagatgatgccttgtcctctacctacggtgtttacaacgcagtgcggactttgtttgcaactgattactactacgacgggcatggcgaattccaaaatactcgcggtaagagtatcggtgatatttcttcatggggacccggaacgccgggcagcggattttccagtatgtggaacaatgcataccgggttatcaaccgtgccaactacaccattcagtatgtagagcaaatgattcaagcagaacagaatgccgcaaccaaagcatctttggaggctatcaatgccgagaattacttcctgcgtgcattggcctatttccgtttggttcaaaactggggtgatgttccttactatcgccacgtactcagcggcaatgatgaagcatgctcattggtacgcacccctattgctaccatcattcctgaactaatcaccgatttacagaatgcatccgaaaagcttcccgtaagctatggtgataagtacggacgtgccacgcaagttgccgcactgggctttaaagcaaaaatagaattgtactatgcttgttggaacaagaacggatggcccgaactggaaggcttcgagccgagcagcagtgtagcccaaacctattatgccgccgctgcttcagacttcagcaaagtaatcaacaattatggcctgacaatctttggtgatggtaatcccggcactgaagacaaacccaactatagagagctgttccaatattataatgaaaattgttcggaaatcatcttctccattacttatggcggtccttctctcggccagggtgaaagtttgttgcgcgacttcggtacccgtaccaccggtaatgcacaatgctggattatgcctactgtccgcttggcaaaccgttaccaatcaactgtcaccggtgatttctgtgatgagcttatcttgtctaaagatgctgcactccctaatggagcacgtaaccgtgccagctatgagaatcgtgactggcgtatgaaatcgaccatcatgtgggatggtgagtcttacaagaaaattacaacggacggcctgacaatgggtgacgaatatacctggatgttcggtgaaagaaatgaggccaacggtttcatcaataatgatgccagcaatcaaaccggttatatcttccgtaaatggatacgccaggaagccggttgggagcgtacagatggtccgcaggatttctatctgatgcgtttggccgatgtgtatctgatgtatgccgaagctgtcaacgaaacgtccggtcctaccagcgaatgtgtagccttgctgaataagattcgcagccgtggcaacctgccggctttaacacccgacaagtatgccaattccgaagcattcttcaatgccattgagcaagaacgtattgtggaactggccactgaaggtatgcgtccattcgatattcgccgctggagaaaaatccatgacatatggggagaggcaaacagtgacggtttaaccttgtatgatacaaatggcacacgcatacgtgatgaattcaagaatgcacccgaactcaatttccaaaagaattatatctaccagattccagaaaacgaaagaaaccgcaatccgaatctgactcagaatactccgtggagataagcaattaccataaagttcattaaatacaaaaagaatcgtatgaaaaacctatataaaatattgactcttgtcatagtatgtcttttgtcccaatcatgcaatgattatccggtagatgataatggtttgctggttactgacagtgaagaatgttacatctcttccctcatattgagaggaccggatgatagggacgtattgataagcggtgttaccatcgatgacgaaaacaacaccattacggggatagctaaatttggtaccaacatcaagaaactgaagccagaatgtggtactgccaaagattgtatcgtaactccgactatgggagtgtggactgatttcagccaaccccgccagtacactgtaatttccggtaatcgtcaagtgaaaaagacctatacggtcactatcactttgcaaggagaataatcaatcagtataaacttctaagaaacagaatattgttatgaaactattgaaatatgcaatgctgcccttcatcgctctctcttgcttcgcatgtagcgatgacgatgaatctgccattaaaaatgacatgataaagaagacggtttctcctgccatagccggagaaaaaatagagtttgcctatgccatgggaaccactaatggaagaataaataaggctgaagcagttgcctccattaccggagcaaccagtacgggatttgagctgcactcctggttcacagcacagaccggaatggatgttaacggtgtacattatggtgccggtgaagatgtgcctatccaaaccgttaaagacgcatctaccgacggtagcatttctacagccaacctgatggagaaagtcgatgcgcattacatcaacccgaccattgccattggaaccacccagacagacctcattgccgccacactacgctataacttcgtagtgcccgaagatgcaaaaggcaaaacattcagcattacctttactgccgtttccagtacaggcgaccgagtgtcttacaaaacccctaattacaaaatctccaagatggacatgaaacgtcttatcgaattggagaacgaaggtgcctgctacttctctatcgaagacatgaaggcttataccaaagaggaagtaaacgctctgaacttgtccggcaagattgatttcatctataactaccaggccaaactgaatgattttgactatgcacactctttcgtatctcctgcaacggacccgaaattcatcgccatcagtggtattgtcccctcgggtgccaccaacagcacccccatggaacaacgtgccaatgtgcatgatgcccagttgaaaggaagcaatccggctgtttacgtggacgatatagacttcgagacgctggatttaggcggagccatgaactatgtactgaacctgaaaaaggacgatagtgcatttatgaagactgccgacggtaaatgggctgcatacatctacgtgaacagcgttgacggtagcggtaagatgacagtaagtatcaaacgttatcctttgtaatctaaccccttacacaacatgaagcgaataaaaacattgacttttctgctcatgattatcctctctgtaggagtatctgctcaaaatccccggtcggtctttaccgaccgaccggtggatgaggcagctatatatttcactcccgagaattttaaagtgaaggctgacgggcgtatggatgtttccgaagccttgcaagaagcattgaaccgaaccaaacaaaaagaaaatggttgcggtatcctctttatccccgaaggagtgtataaactcaacaagacgatttacatcccctcaggtgttcgtatcattggttatggtggcaaacgcccggtttttgtccttgccaagcaagcacccggttttcaggaagttacccgggaaactgcaaaagggaaataccttttttggtttatcggcggcggctaccgcccgggaggccgtataggcgatgccaatgcagggactttttatagttcaatgatgaacgtagatattcgcattgaaggcggaaatcccaatgcctctgccattcgcgcacattttgcacagcactgctctatttccaatgtaaccattcatgtgggaaaaggccgtgcgggtattgtcgatgccggaaaccatttggagaatatagccatttacggaggagagtatggaattgacacagacaagtcagctcccggatggcctattatgctacttaactcctattttgaaggacaacgtaagagtgccatccttactaatgaaggaggattgaccatcgttcgtatgcgggcaaagaatgtacccgtagccgtagagattaaagagaatgctcccgacaggctatttatggaagattgcattttcgagaatgtacaccgcaccggggttattctgacagatgcaggaaatgcagcaacacaaatcaatcttagaaatattcaatgtaacaacgttcctatgtttgcgttggagcgctttacaaaccaacaaatacccggtaaagaaaaaacataccgggtaacccgtttcactttcggttttaatgccgacagtctggaagacactcctcaaatagtgcgccggacagaaacagaacctattaagagcattactcctttggataccggtgacaccccgatgcttcctgctacggaacaatggataaacatccgcaacttgggtgccaaaggagacggtttcagtgatgatacacacattttccaggaagcagtacaaaagtatgccaatatctatattccccaaggatggtacgttgtaaaagagccgttgactctgaaacaaaacacgaatctgataggcctgcaccccggcactactatcctattaagcttgggcggcaatcccgcattcagcggcttcggtgccccgcaagcacagttgactactccccaaggtggaaagaacatcgtatgcggtatcttcctgaatgccgatgcctacaattatcgggctgtcaattgcaaatggatggcaggcgaaggctcttatatgtatgatgtcaaattcagcgggcacgataaagcccgtttcttccacaacggacaaagtgctgccaaccctttggagaaacctatgtccatcactccggaaactcacgacctcattacccgtgcttgggacaaccagcattggagcctatggattacaaacggaggaggaggctcattccgggatatatggacagccaacgaatatagttcggcaggactgtacatcagtcatacagataccccgggacgtatttacggaatgtctttagagcatcatttacgcaatgaagccatcttccgcaatgttgccaactggaaaatctacgacttccagtttgaagtggaagcagaaggcatcgatacgcaacctttggacctgatagactgcaagaacctgacttttgccaatttctattcctatcgcgtatcgcgcatgttgaaatcctatccgtcggctatacgcacctggaattgcaaggatattgagtttctgaatgttcacaactatgcacatgcccgcgtaaagttcacttccaatgccagcctttacgatgtcaatacccaccgggaagcacgccgttgggaactggcacgcctttcattgaccggcaaggaaagccgtaaatacccattgagccaggaaaaaggaaaagccgaacttgtagtcaccggatttgagttcattgacggactggcacaagacagccggggaaatatatatttctgcgagcatcgcatgcgccgcatctataaattggatgcccgaagcgggcaggtaacttctattgccgatttcccctggaacgcagtagcactggcatgcgatacacaagacaacttgattgtcgttaccaaatacatctcccaacccggctataataatgacgatacccgtaacggcaaccgtcctctattcggctggaaaggttcgggagggctgtggggcttcaattatgttcctaagttttacgcaatacgtcccgataatccggatgaaagtttccaagttttaccgttagtggatatgaagcaatttgctgcaccgcaacaaatttattatccgggtaatagaaccatcactcaaagcgagtattacaacggaagaaagccggaacaatgttttgttgctcccgacggtgtaaccatcattccgaattacgaagatttattccgttgttcatctctggttaaggcagtaccgggcaaaacagtctatacattggatgaatatcaccaacgcgtaatccatgcggatgtagatgcccaaggcttcttgcaaaactgtcgcatatttgccgacggaggcgaccggagcgtagttacggactctaaaggcaacgtatatgtagccaacggagacatttccatattctccccgtcaggtgaatccataggtacgttagaggtgccggaacgtcccacgtctctactgatatcaggaaacaagctctatatcacagctctttcttcgctctatcaaatagagctttaacaataggattatcataataagagattaggattataaatcatgacaaagtgatattttcataggttagatttttaagtttgtaactaaggttgcgattcaggtttaagttaaagaggcggataactacttgttttttttacatccgtctcttttttagtagttttggcagtaatatcatttataacatatcaccatggaaagagagaaaaatacactcccgcaaaaggcctgccattggatggctgccgttattatatccttatttgtcctgccccctgtccacgcccaacgccaaacccaaaccatcaacgacagctggaagttcctcaaaggagaatgcaccgcagcagccgacagtgcctttgacgacagcaaatggacatccatccatctgccccatacctggaataccgatgcttataccgaaaaggattactaccgcggcacgggctggtatcgccggcaactgaccttgccgcagggctggaaggagaaacagattatcctgagactggatgctgccggcaaatcagccactatctatatcaatggcaaaaacgtaggtgagcatgccggaggatataccgcctgttcattcaacatcacgccgttcctctctttcgacacacccaacacgctggccgtatgcgtggataatgcccgccaggatattgctcccatctccggagacttcactttctttggcggcatctaccgggatgtttggcttacggcggttcccaaccagcacttcaacctaacgaaccacggctcggacggtctgttcatcagcaccccgcaggtttccgaggagcaggcaaccctctccatacgcggtgaagtaaagaacgatgcaccggaaaaagcgacgttggaactgacgcacaccatctaccgcccggatggtaccctgctacaaacactcaagaagaatatacagctaaaagccggagaaacctacgctttcagcaacgagacaaccccggtgttgaaacctgaattgtggactcctgaaacgccccgcctctaccgcgtagaaacaaccctgcgcaaccgtaagaccaaaaccttgctggaccaaagcaatcattacaccgctttccgctggttccggttcgacggagatgagggtttcttcctcaacggaaagccctataaactgcgcggcatctgtcgccatcaagaccagaaacccataggtcccgcgctgacagacgagatgcaccggagagacttcctgctgatgaaagagatgggggccaattttatccgtatctcccactatccgcaagacgatgccctgctggagatgtgcgacaagctgggtatgctggcatgggaagagattcccattatagacattgtgcccgatacgccgggttatggagataactgcgaacgaaacttgcgggaaatgattcgccagcactacaaccacccttctatcatcacctggggatatatgaacgaaatattgctcgtaacccaacggaagtacaaaaccgaagcggaactgaagccggtactggaacgcacactggcactggccaacaggctggaacgggtactgaaagaagaagatagcacccgcataagcaccatggcattccacggcagcaacagctacaacgaaaccggattaagcaaaatcaccgatattgtaggctggaacttataccagggatggtatgggggtgacctcacgggctttgagaagttcctggcacaacaacaccaaaaccatcccactcacccgatgattgtaagcgaatatggtgcaggttcggacaagcgattacattcgctgcatccgcgtgcttttgacttcagcatcgaataccagcagaagtacctcgaacactatttgccggtattggaagatacaccttatatctgcggcggcacgcactggaactttatcgacttctcttctgccctgcgagacgaatccatgccacgcatcaacaataaagggttggtttatgccgaccgtaccccgaaagatgtatatcactactatcaggcagcttggcgcaaggacattccggtgctgcatattgccagccgcgactggacagaccgtgccggcgtgcagcaaggcaatgctcccgtatatctgccggtcaagatatacaccaacctttctgaagtagagctgtttatcgacggtatttcattgggaaagcagaaaacagagaactacacgggcaccttcgaagttccattttctaacagaaatcctttcctattcgcacaaggaaactatcaaggaaagacagtgcaagacgggctgagaataaacttcactcccataccggcatgcctggatgcaaacaacctgaaagggttggaactggccgttaatgtaggaagccaatgcttcttcacctcggacgaaagccaactgacctggctacccgaccagccttatgccgcaggcagttggggatacatcggcggtaaggagggaactgcacaaaccgaaatccaaaacacggcagacgaccccttgttccaaaccctccggaatgagatagaaggttatcgcttcgatgctccccaaggtgtatatgaaatagagcttctctttaccgatatcttccgccggaatgcgggcattgcctaccaactggaccggaacgggcaacaagagaaccgggaaaacacattcggcatttccataaacggggaagtgatggaagagagcctctctccctgcaaagaaagcgggtacttccgtgctttgcgaaagaagtactacattacgaatgacaaagaatacatcgatatacgcttccattcaacaagcggtacttgcttcctgaacggtattaaactcagaaacatttattaatcaataaaatagaaaaccatgaaactaaaagtagtacaatgggtgcttgctttattgcttctggcgccttgcacacaagcacaatccatctgggatgccacgcaccttgccaacgtaaaacagtccatccatgaacctttctacgcaaccgcctaccaagcattgcaagcggaggccgataaactattggatgtacagcctctttccgtgatgatgaaagagaaggtgcctgccagtggcaacaagcacgactacatgagccaggcccgctattattggccggaccccacaaagcccgacggactgccttacgtgagccgcgacggcgaatcgaaccccgaattgaacaagctcgaccgcaaccgcctgggagcaaccgccagccgcgtcaccacgctggcactggcctggtacttcagcggagaagagaagtatgcccaaaaggcaacggagcttatccgcgtatggttcttcgacaaggatacacgcatgaatcccaacctggagtatgcgcagatgatacccggacacaacggcggcaaaggccgttgctacggcgtgctggatagttactcctttgtagagatgctggatgccgtgaagttgttggagcaatcgaagtcttttacggccaaagattccaagcagctgcaagcatggttcggcaagttgctgaactggatattgaccagcccgcagggacaagaagaatcccgccaggccaacaaccacagtacggcctacgatgcgcaggtgatagccattgccctctacaccggcaaccttaaagtagcccgggaagttatcaacgccgttcctgccaagcgcatcttcacccagatagaaccggacggacggcagccgcatgaattgcgccgcacgcttgccttcggttattcccaatacaatctgacccatctactcgacatcttctgcatggcagagaaaataggaatcaggattgataacgccacctctcccgacggacgcaacttctaccgggcaatggatttcctggcgcaatatgcaggaaagggtacagaggaatggccttaccaacagattagcgaatgggactacaaacaacaggaattctgtaaagacctataccgtgccggcttgctcaaccctgcacgcaaagactatctgagactatccaaagcccacagagtcattcagtggaaagaccgcttcaacttgctctatgtgcaaccctccgaagtggataacgcctatgcctttgcctgcaaacaactggaatttgccatgcagtgcgccgacaaagcaaagaaagaggagaagaatgctgcccggcgtcgcgtcatgccgcgcagcatccataaagacggttcgctggctatgatacatccccacgattggtgctcgggtttcttccccggctcgttgtggcaggtatatgcctatacgcatgatgattactggcgccgggctgccatctcgtggacctggcctattgaagaagccaagtggcacaagggcacgcacgacctcggctttatgatgtacgacagctttggaaaggcgtatgaactgacgggtgaacgctcttacaaggatgtggtgctgcaaagtgccaagactttgattacccgctacagcccgaaggtgaaaagcatccgctcatgggaccacaatcgcgaccgatggaaatatccggtcatcatcgacaatatgatgaacctggaaatgctgttccgcgccacgcagttgacgggcgattccatttactggaatgtcgccgtgaaccatgccaacactacactgaagaatcatttccgtccggactactcctcttatcacgtagtggactaccatccggaaacaggtgaagtccgcctgaagtgtacacaccagggaaactcggacgactccttctggagccgcggacaagcctgggggatgtacggctttgccatgtgttaccgcttcaccaaagaccccgcctatctgaaacaatcggaaggcattgccgacttcttcctcaacctgcccaacatgccggcagacggcgtgccctactgggatatgaagatggatgtcattaaggactgcacccccgataacatcaaccccgacgtaccacgcgatgcttctgccgccgcactcatcgcttcgggtttatatgaactctgcacctacgtagctccggagaagggtaaacagtatcgcgccgttgccgacaagattgtcgatagcctcaacaagcattaccgggcagaaccgggcactcactacggcttcctgctgctgcattccacgggacatcatccgggaggaagcgaaatagatgtgccgctgaactatgccgattacttctatctggaagcgttggcaaggaaagaggcgctggacatgaaataaagtttattcgcaagctgcggatatgtatccggggcttgcgaacgcttatccgcgcactgcgaatgtttatccgcaagctgcgaacagagaattgtcttaagagaaaagaacttttctccctatacctcagaactttgtccttaatacctaacaacttttatatatataccccgcaggacgtatatatgtatcatttttataacataccatgaaagcaccccgaatcctacttagtctattgttcagcagcctgttgttgcaggcacacgcactgattcctaccgaccgcaagcaacgtcttacggagcattgggagtttatccgccaggatatgggaagcatttgggaagtgatgcgccctatcaccggagcaggaaagcccgaaaccgttcccctctggcagaaagtcaccctgccccactgcttcaatgcggaagacgccgttgaccctgatgtgaactattatcaaggccccggctggtatcgcaccatgctcaacatagagaatccctataccaacggacgtacctgcctggagtttgaaggcgcgggacagaagacagaggtatatgtctataccacccgaatcgcttcgcacgtgggtggttacgacgagtggaaggcagacatcaccgaagccgtggaagcattccgtcgcacgccgctctgccgggagcgtttcggcggaaagattcctattgccattcgctgcgacaacagccgcgacacggagcttattccttccgatatgtccgacttcaacctctacggcggactctaccgatatgtcaacctcgtctatacgcctgccgtccattttgagcagatacggatagaagcaacaaccgatgagaaagggaagcaaggcagtatctcgatagacattgctttcggcggactatccggcaaggagaagaaggcaaaagagttctctctccgcgtcttctcacccgaaggcaaggaggttaattccatatcatccgagcttacggaaatatcctcgtaccagatctccctgaaacgcccgcagctgtggagcccccactctcccgctctctacacctgcgtggcagaacttatcgacaacggagataccctgcgcaccacccagcacttcggcttccgccatttccgcttcgaagagaaagggcctttctacctgaacggcgaacggctgctgctgtgcggcacccaccgccatgaagaccatgccggagtaggcgctgccttgaccgaagagatgatgcgcaccgaaatgcaacaaataaaagagatgggtgccaactttatccgcctggggcactatcagcagtccggcatcattctgcggctctgcgacgagctgggacttctcgtctgggaagaaataccctggtgccgcggcggtctgggcggagagagctacaagaaccaggcgcgccggatgctcaccaatatgattgagcaacatcgcaaccatccttccgtcatcctgtgggggctgggcaatgagaacgactggccgggcgatttccaaacgttcgaaaaagacagcatacgcgcctttatgggcgagctgcacgaccttgcccatcgcctcgacccgacgcgctccacagccattcgccgctgcgagttctgcaaagacattgtggacgtttactcccccaccatctgggcgggctggtatggccgccgcttccgcaactaccgcgagatggagacggccggaataaacgccaccacccgtttcctccatgccgaatggggaggcgacagccatgccgggcgccatatggaagtgaacaaggagacgggcggaaaaggaatagataacttcgacatcgaagccgcagaccgcaacggcgactggagcgaaagttatatcatccgcctcttcgactggcacctgaaagaacaagagaccatgccccggcttacgggaagcctcttctggactttcaaggacttttccactccgctgcgcccggacaatcccatcccttacgtcaatcagaagggggtggtgcaacgcgacggcaccccgaaagagagctattacgtctttcaatcctattggagcagcaaaccgatgctgcacatctatggacactcctggccggtgcgctggggtaagccgggcgagcccaaggaaattctggtctattccaactgccccgaagtggagctgtttgtcaacggtgtgtcgcaaggacggaagaagcgcaacagccaggactttccggcagcagggctgcgctggaatgtgccattacgagaaggaaacaacaagattaccgccacgggctatgacggcaagctgcgcctcgacgatgaaattcagcaggagtatcaaacccgaacctggggcaaaccgtcaagaatacttctgacgcagaccgcccagaatgcggaaaccatacttgtgcaggctgaactgatagacgaaaacggcatacgctgcctggatgcctgcctgttcatagaattcggctgcacggacagtgaagcgttgctccgcaaccaaggcaccgcgcaaggctcactccgcatacaagctgctaacgggcgggcaagtatccgcgtaaacaagcagcacgcacccgtcgtggtgagtgcatctgatagcaaacgaatcttaaaaaccgcactaatttccgtttccggccagtaagataagtattttagcactctatttaagcactgaaaatgatttaatccctaactttgcgaaaaagattcattttataaactaatacataacattatgaagaacttattcaacatcaaagacaaagtagtagtaataaccggcggaacaggagtattaggaaaggctatcgctcttcatctggcggaagaaggagcgaaagtagtaatcttaggtcgcaaagcagaggtaggaaacgccatcgtcaacgaaataaagacaaatggcggagaggccttgttccttactacagacgtgatgaaccgggagatactggaacagaacctggcagatatactgaaagcctatggccgcatagatgccctgctgaatgcagccggcggaaatatgccgggtgccaccatcgcgcccacgggcactttcttcgatttgaagatagaagagttccaacgggtgcttgaattaaacctgacgggtaccgtactgcctacacaagtcttcctcaaaccgatggtggaacagaagacaggcgctattgtcaacttctccagcatggctgctttccgccccatgacgcgtgtagccggatatgctgccgcaaaagccggtatctccaatttcacagccttcatggctacggaagttgccaagaagtttggtgaaggtattcgtgtaaatgccatcgcacccggatttttcctcacagagcagaaccgtgccctgctgacgaacccggatggaagctacacggaacgtgggcaagatgtgattcgccaaactcccttcggacgtatgggccgtgcagaagagctttgcggaaccatccaatacctcatcagcgatgcttccagctttgtcaccggtacggtggctgtagtggacggagggttcaacgcattcgccatgtaaatagtaaattgcaaatcatcaaacaataaataacatgattctttgtgaacaaacctggcgctggtacggtcccaacgacccggtaagcctttgggacatcaaacaagccggggctaccggcattgtaaacgccttgcatcatattccaaacggggaaatatggacagtagaggaaatcaagaaacggaaagaaatgattgaagccgtaggtctgcgctggtctgtagtagaaagtgtacccgtacacgaacatatcaagacccaaaccggagacttccagaagtatatcgacaactataaagagagcttgcgtaacctgggcaaatgcggcattcacattgtcacctacaactttatgcccgtactggactggacacgtaccgacctcgcctacgaactacccgacggcagtcgtgccctccgctttgaacgtgccgccttcatcgccttcgacctcttcctgctacgtcgtcccggtgcagaaggcgaatacaccgatgaagaaaaggccaaagcccgtgcccgcttcgaacagatgacagaggcagacaaacaactgcttgtacgcaacatgattgccggacttcccggttcagaagaaagcttcaccctggaacagttccagcaggaactggaccgctacaaaggcatcactccggaacgcctgcgtgccaacctgatttatttcctacaagaaatcgctccggtagctgacgaagcaggtgttatgcttgtcatccatccggacgacccaccgtgctccatcctcggcctgccacgcatcatgagctgtgctgccgatttccaggcactgattgacgctgttcccaacaagagcaacggtctttgcctctgcaccggttcgctcggtgtaagcagcgccaacgattgtgcagccatcatgcagcaatttgccgaccgcatcaactttgtccatctgcgcagtacacaacgcgacgccgaaggcaatttctacgaagccaaccacctggaaggagacgtggacatgtatcacgtgatgaaagccttccttgaactgcaacaacgccgtggtgtctctatcccgatgcgacccgaccacggacaccagatggtagacgacttgaagaagaaaaccaatcccggctattcctgtatcggccgtctgcgcggactggcagagcttcgtggactggaaatgggtatagccaaatcgctgtacgaataaggcacaagatatagcaagcataaggaaagaacaggaagccctccgtccgaaacttcgaagtttcggacggagggcttccctttataagttttctgccatcagccgcctcttcttaaggcactgtctgccgacatttatttaccttcttttgcagcaagcactttccatacaacggcactcagtgcagcacccacaaacggagctacaatgaacagccacaactgagagagagcctcgccaccctggaacagtgccggaccgatgctacgggcaggattgacagaagttcccgtaacaggaatacaaacaatgtgcactaataccaacgtaagaccaatggccaatcctgcaagattacccgcccccttctcggaatccgtagaacctaagacaaccagcacaaagataaacgtgaacacagcctctgcaatgaatgcctgcaacatcattccgtcagcaaacccattggaaccggtagccgtaggaccaccatgagcgcccgtagacaccaatgcataaagaatggcagaaccgataaccgccccgataacctgaaacaccatatacatggctgcatctttcccgctcatcctgccggacaacagaacgcccagggtaatggcaggattaatatgacagcccgagattcctccgatagcgtatgccatcgccacaacggacaagccgaaagcaaaagctactcccagcgttccgacacctgcactaaccgccccgccgcacttccggcaaagacagcactaccacatcccatcaggacaagaaccattgtcccgatcatttctgctaaatacttcttcatgatagtttttattaaacattgatttctgcaagaataaatataaaagatgaaaatctgcccaaacacggcggtaaaaactcacccattactacaaaacatcactgctttgactctaacatccagcatatctgcatcttctttagccaacccgaagaaactcagaaatataagaaaacatattggcttgtaaagagtacaaagaaagggtgcaacctcacggccacaccctccatctacactatctttgataataacctaaaaggaaactttatttccctacatcatttcaattcaaaaggaaccgttcccttcacatcggctgccgaagctgctatgacagcctcgaacttacccggctcggtcacccaagcgtgctgggtgtcatcgaagaagctaagagcctccttatcaatggtaaatgtgacttcctttgtttcgcccggagccagtttcaccttttggaaacctttcagttccttgacgggacgaggcagagaggacttcttgtcactgatgtacagttggacaacttcctgcccttcgcgcgctccggtattctttacagaaaccttcacggtcagcgtaccgtcggcctgcatggtcttgctgtcggctgtgggcttgccatactcgaaagtggtatagctcaaaccgtggccgaaggggaacaacggtttcaccttcttctgcttatcggcccaacggtaacctacaaaaatactttcattatatttgatgtcgatgatgtccttgctccgcttgccggtatattcacccaggctgtgggccgggcaatcctccaacttcacggggaaggtaaacggaagcttgccactgggattcacatcccccataaggatagcggcgagagcactgccagcttcggaacccagataccagtcctgaacgatagcaggcacctcgttcacccacggcatggcaatggcgttgccggagatgttgacgacaatcagattcttgttcgcctcggccagtgcggagataacggcatcctgaccgtaggacaagcccagacccttacggtcggagtcctcgcagtcctggccgttgctcttgttcaagccgccgatgaagatgacataatcggcatcccgggcctctttcacggcttcagctatcagctcttcgggagtacggtcatccttcagattctgtccggtcaccaccccgttgtattcaccgcttgcatcgcccacgtagccacgggcatagaccacctcggccttgccggccacacgctgcttgatgccgtccaacggagagagttcgcgctgtaccttcagggaagaactaccaccgcctacggtcatcatcttgatggcattctcgcccactacaagaatctttttagcccggttcaggtctatcgggagcacattgcccttgttctgcaacagtacgatgccctcctcaccgatgcggcgggcagcctcgtaatgttccggagagagcatgcttccccacggacggtcggggttcatcaccgtacggaagataaggcgcagaatgcggcgtaccttgtcgtccagttccgtggtacctaccttaccttcgcggatgaggttcagatagggatttgccagataatagttatcgtatgcgttgctggcaccgttcgagagcccgttggtccaactgccgaattccatatccagcccgttggtgatggcttgccgggtatcgtgcgtgccgccccagtcggaaatgactacgccgtcgaatccccattcgcccttcaatatatcattcaatgtgtattggttgtgacaaagatgttggcctttgtataggttgtaggcacccatgatgctccacgctccgccttcctgcacggccatcttgaaagcaggcagatagatttcataaagagcacggtcgtccacgatgacgttggtggtgtggcggttcacttcgtggttgttcaaggcgaagtgtttcacgcaggcagccacgccgttctgctgcacgccccggatatagggcgacaccatctttccggccagataagggtcctcacccatatactcgaagttgcgtccgttgagcggtgtgcggtagatattgacaccggggcccagcaggacggacttgttgcggtagcgcgcctcttcaccgatgctctgtccgtaaaggagagacatttcggggttccaggttgccgccagacaggtcagggcagggaaagccacgcaggagtcgttggtgcatccggcttgttcccactcgtcccacaacacatcgggacgtatgccgtgggggccgtcgtccgtccatacatcgggaatgcccagacggggcacacccgcactgctgaacttgctttgcgcatgagtcaacttcactttctcttccagggtcagacggctcaaggcgtcttccactctttcttcaataggtttgcttgcgtccagatagacgggcttctgctgggccgaaagaggcagcgcgacagcggccagaaccaaaccgaataatacttttttcattgttgtataattaagttgttatataagtaagcaatcataatcagtccgtaccattgataatctccaacatacaagggaatatgacttagccctacctacataggaactgaagtccttacacccgtatagtgagtacccataacatccggatgttgttgtccaaaacatccccatgttttaccccaaaacacccggatgttttatcccaatatatccccatgttttgccctaaaacatccggatgttttggatgctcagtcctatggtgtgtacagctcagtccctacctctttcatactaagtcccggcatctcatcctctgggacttgatacgtactgtttgcagcgaggcagcacccgctacttcattcccaatgaccggatataaccctcctgaaccacacaattcttcagtttgcatgcctcgataaagtccatcatcgccttgcgggacatggcctgcgcgggacgtgcctcacggatttccttgtacgtggcacgcggtgcttcggagaaatacacgatgtttgcccagttctccggcggagtgatgccgacgaaagaagaaccgtccatcttcttgtagggccagaaggtatagccgatgttgttctcgcgcatcgtctggcagaaagcggcctgccattcgtccgtattgtggcctatctcacccatgtacatgggcaggttcacactgtcgcggaagttgataatcgtctggatggcagcttgggtaggttcgcctccgtaacggtggcaggtgtacattatcttgtcgtcgaacttggagtccttgaaaggcttgaaattaccgttccattgcgcaccgcccagcaggatgatgtggttgctgtccacctcgcggatggcggctacacctttcttatatacatcttccagcttgccgttgagttcctccatgttctcgaagtaaggggcaatgggctcgttgaagagttcgtagccgaggatgaccggttcgtccttgtagcggtcggctatccggcgccagatgtcacagtagagttgctggctggcttcgctgtcgaacagccagggatagccgtagctgtcgtcgatgttgtcgcctgtctgtccgccgggagcgtcgtgcatgtcgaggatgaggtacaagtccgattcgcggcaccactctaccaggctgtccacgcgggcaaatccgtcctgggcggcggtcagccccatatagtcctcgtcggtaaacagcttgtagtggaaaggcaggcggatggtgttggcaccctgctccttgatgaagcggatgtcctcgcgcgttacataattgtccttgaatgctttccagaagtcggccgtaaagtccggtcccaccaactggcagaacatctcattgatgaaacggccggaattggtcttgttgaacttgaacatgtatccttccggattcagccagttgcccaggttggtacccatgatgaagagtttggtaccgtcgggctttatcaagtcctgaccctgaatggttacgaatgcatccgaagttacttcttttgtcgcttgtttctcaccgcatcccgcaaggcccaaagacagcaaggcgatggaaatgcttgtcgctaataaatgtttcatggcaataattttggttatggtattagttgcgatattcgcttttacttccccaaagttaggaaagataagaacacttcgtaccggcgaatcgggaataggtggaagaagtaaagaagcacaaacaaacaaacaactaataatcagaaatataagtagaagaagagaaaggcagaaagtggattcaaaaagccggtttgacgtattgtcagcgtatctgcatcagccgtatttcaaagtcctcgcgcgaaatgcgggccttgttcttcactttggcacggtaattatagatggtgtttacggaataacggaggaattctgcaatctgcgaactgtcgtcgatgcccagacgaatcaaggcgaaaatgcggagttccgtattcagcaactcgcctttacggagcacgatgcgttcttcgggctgcagcaagtcattgaatttatcgacaaaatcggggaaaaggtgcaagaaggcagtatcaaagttatcatagagttccttcagtccggtgtccagcacctcgcgggaacgcaccatcttcagcagctcttccatctgcccggcagagattttcttgttgaccatccgccggtaggtatccagccggttgatataaacggagcagagattcatgaaacggcccacatactcctccttgatgttgtttgagagttgcagttgctcgttggcatgctccagcttgttccgtgcggcagagagtcgctgcatctgccggtagataaagcccactgccaccaccaacagcacaatcaaagcgctgatgagccagaggtacagccggagccggtcattctgcttctcacgcatggcctgataagtgaggtctatcagtgaaaggatgccggcagtctggaggctgcggctacgggcgttgtatcggttggtttcgtcccacgagaaacggatgtaacggtaggcatgctccatatccccttcctcataaagaagttccgccaggttccagagtgaggcatggtctgtgatgctcaggcgaatatcggtcagtgcagacaaagccagatagcgcttctcctcctcccggttcccgagccggcggtagagcaatgagcgctgataggtcaccagcgcatattcgggagtattgggcttggcatgtgccagacgcgtatcattgatgctcaaggcttcgtccggatggcctgcagcggcctcccgcgtctctcttcgttccagatagaggggggatgaaggcagaagtacctgcatcaaagaatcgtcataatgggtagccaaagcctgataatgcttcttgaaagaatcgtccagcgtatagaaactcagttctgtgtaaagtttatgacaggcattgtaataatccggcatcagatgggtgggaagggaggctttgtccgtctgcctcaagagttcggcggcttcctcgtacatgcctgccgaagccatcaggtgggcaagctccagccttgtttcgagtgctgcattccgttggccatagcgttctgcccaatccagattgacacgaagataatggatggcagagtcgcagatatatgccttgtactccttataaatttctccattccatcgaaaaaaagagagattggcggtgtcggcatccagcaattggcgcttcagccgggcaatgcgcccttcacgcacggcgacatagtgccgatgcgcctcgatagcctcatccaaagaagccgtcagtgcagtgaaagacgacgtgccggcagccaaagccacactttgccataccacgacggcaagaaaacaaaaaatgaacaatctcctttccatgaccataaagttcatgcaaatatagcaagaaatcctgcaaagcagtagcatcggaaagaatagtttcctatatttgcgttcaaaacccccaaacaaattatctatcatgaaaagcttaacactccaacggattgccgcggtagacgtattccgcgcactcaccatgttcctcatgctctttgtcaacgacattcccggactgaaaaacgtgccccactggctgatgcatgccaggatggacgaagacatgatgggattctccgacaccatcttccccgctttccttttctgtatgggcatgtccgtatcctttgccatacaaaaccggtacaaaaaaggagacaataccctgcaagtcgtggcccatatcttctggcggacagtggcgctgattgccatgggactgttttcactgaacagcggaggcatcgaaggcggtctatcgcaccaatggttctccatcctgatggtcatcggtttcttcctcacctggggggtatatcccaaagcggaaggaacgaaaaagacccttttcaccgcaatgaaaacagcaggcgtgctgctgctcgccttcctcgtcatctacaaggacatgaacgggaaaccgttccagataagctggtggggcatcctcggacttatcggctggacgtatgcggtatgtgcaggcatctatctgttcacccgggaaagcctgcggaagaatgccattgtctggttcgtggtcgtattgcttgccgtagtcagccattcagacctgataccgggagagtacggcagccggattatcctgcttccctttatcccgagtgactggacactgcatgccttcggtatgtccggcgtattgacctctctgctcatgcagcgctatgccgaccgggaacggccgggacgattcatcggcatgctttgtgccctcggcgtaggaatgcttgtccttgccctcgtctcacacccgttctggattatatccaaaatacaagccacgccgacatggttgttctactgcctcgccatgttcttcccgctgttcggcttcttctactggctgacggacgtgaaaggcaagaccaattggttcgatatcatcaaacctgcaggtacggcaacgctgacctgctatattattccttacatctggtatgctgtccagcaactgctgcatctgcactatcccgaagcattgggaagcggcgtgccgggactgatcaagtccctcgtgttctcgcttgtcattgtcgggctgaccggcttgctggtgaaagtaaagattaaactgaaagtataatgttgaaagtccaaacacccaacggtgaagacaaggtgctgctgcattcgtgctgcgcaccttgctcctctgccatcatcgagtgcatgctggaaaacggcatacgccccaccgtattctactgcaatcccaacatctatccgcaggcggaatatgagataaggaaaaacgaggctatccgtttcgtaacctccaaaaacatcgatttcatcgatgcagactacgattatgcacactggctgcacaccatgcaaggcctggagcacgaaccggaacgcggcagccgttgcctgaaatgcttcaccctgcgcctgacagagacagcccgctacgcctccgagcatggtttctccgtattcactaccacccttgcctcttcgcgctggaaaagcctggagcaaatcaatgaagccggacgccgtgccgccgcgctctatccgggcaccctcttctgggaacagaattggcggaaaggcggacttcaagaccggcgcaaccaactgctgaaagagtacgatttctataaccagcagtattgcggatgccaattcagcatgcaacggctggatgcaaagcaagaatcaatcaccgataaatgagcgtcgaaagatagtcctcggcaaacatctcgttcgccacctctaacagcacttccgaagtgagctgttcaatgcgatggaacacggcttcggaagtttcgcatttatcataatgcaggaaagtcttgcccatgcccagcgcattgttctcattgttgtccgaagctacaccgatttgcccgataagctgcttcttggcggccgcaagctgcgaggaagtcatccgggcatcacgcaggcgtttcaattccttatataccaggcgggtgcagtagtccaaatctgcagggtcgcaaccgaagtagatgcagaaggtgcccgtatcggtataggaggtcaggttggattccacgttatagaccagtccgcgacgctcgcggagagaaacgttcaggcggctgttcatgcccgggccacccaggatattgttcagcaggtaaagtgcggtgcgcttgtcatcgtacgcattatatccccggctgccaatcatgacgtgtgcctgatgggtatccttatgcactacaagatgctcgggcacatagaggggcggcggagtacggcggttgtccactgccacggcaggtaaatccgcgaggagcttttccgcccagcgcaccacctgcctgaagtccagattgcccagaacaaaaaagaccatattgccgggatggtagaaacgggaagtgaatgcagcggcatcctcactgcggaacagcttcagctgcccgggattgcccagaatgttgcgtcccaggggatgccctctgaatatcaagtcctcgaaatcatcgaagatgagctcggaagggttgtcttcgtaggattgtatctcgtcgataatcacctctgtctccttctctatctcgcgttgcggaaaggtggagtggaatacaatatccaccagaagttcgaaggcacggccgaaatgctcggtcaggaaagcagagtaaatcaccgtctcttccttgttggtgtaagcgttgaggtcgccgcccacattctccatgcggttcagaatgtgccatgccttgcgcttggcggtacctttaaatataaggtgctccacaaaatgcgccataccctgctcgttttcaagctcgtcgcgcgtacccgcatctacggcaaaaccacaataagccactttggaggctgagggttcgtgaatgatgcgcatgccattgggcaggatatattgattgaaagttggcagtaaattttcttttaagttcttcattctgacgtttcaaactatttgaggcgacaaaaatacaataaaacttattgccgtttatagaaaattgcagatatttgcaattgctataattttaagcacattaatcaaattagcacattaagtatgattgcatccattcaagagcttttgcagaaagaggcacaagccgtactgaacattccagtgacggacgcttatgaaagagctgtagaactcatcgtagaacaagtgcaccgcaaaaaagggaaactggtaacttcgggcatgggcaaggcaggacagatagccatgaacatcgctaccaccttctgctctaccggtattccgtccgttttcctgcaccccagcgaagcacagcatggtgacctcggcatcctccaggagaatgacttgttgctgctcatctccaattcgggcaaaactcgtgaaatcgtggagctgacacagctggcacataacctgaacccgggactgaagttcatcgtcatcaccggaaaccccgacagccccctggcacacgaatccaacgtatgcctcagcaccgggaaaccgcaagaagtatgtgtactgggcatgacacccacgacttcgaccaccgccatgaccgtcatcggcgacatcctggtggtacagaccatgaaagaaacaggattcaccattgaagactactccaagcgccatcacggtggttacctcggagaaaaatcaagatcgctatgcgtaaagtaataggcatcggagaaaccatactggacatcatattccgtggcgaacagcccacagcagccgttccgggcggttcggtattcaacggcatcgtttcactgggacgtatcggtgttcccatctgctttatcagtgaaacgggcaacgaccacgtgggcaatatcatcctcaacttcatgcgcgagaacaatattcccacagaccatgtcaatgtgttccccgacgggaagtcccccgtatcactcgctttcctgaacaaccggagcgatgcggaatacatcttctacaaagattatcccaagcagcgcctggacgtggaatatccgcagattcaggaagacgacatcgtaatcatagggtcgtactatgccctgaatccggtactgcgcgacaaagtggtggagctactggaacgcgcacacgacatgcatgccattatctactacgatcccaatttccgttcgtcccataaagaggaggccatcaagctggctcccaccatcatcgagaatctggaatacgccaacattgtacgcggctcgcaagaggatttcttctatatgtggggcctgcaggaggccgacaagatatacaaagacaaagtaaagttctactgccgcaacttcctctgcacagccggcgcggagcaggtttcattgcgcaccggcacgatttccaaggaatattccatccccccactggaggcggtcagcaccatcggtgcaggagacaacttcaacgcaggcatcatcttcgggctgctgaaacataatgtacgctacgaggacctcgataccatggacgaggctacttgggaccaagttatccaatacggcattgagtttgccgccgaggtatgcaagagtttcaacaactccgtttcaaaggaatttgcagaagcacgaaaataccagccatagacacccttacaaaagggtgttcaccacagattacatggcctgaaaatccatgcaatctgtggtagaacagcttccggattaacaaaattctcccgcttttcctttcatttctgctttttttttgctttatttgtctatcctttataccttaagcattcgcgctatgaatacaaaaggaagcagacagcactctccaacccctcctaagcagaaatggcaaaacatctgccttgccttgtgcattcttttaggaatactcgcctcttgcgaaacagaagaatccttctatcaaccccgattcccggcaaacgatgtcccgttgacccggcaagcgttattcaagccggaaaacttctttgcctacaccgactctaccctaaaagccgtgatttccgcactacgcagagtggaagaagaaaagcatttcaccgcttctttcctgttgaaatacggcattcctctctggaacttcacctataaattgactggagaagagacctgtatcttcgttcccctctaccgccttgacaagccacactgcatcgatgccatctggctgttgcacatcaaagacggatggatgaagttttttccattgaagcgtgatgacgaactcataagagaaagcgaccaagtgttcatattcgacttgttaagctatctagtatttggcgaagagaatgcgcaaggactcacattcaagcctcatgcccagacccgttcggtaataaccgtcacccaatgctgggatgtatataccggacctaaagaccagctggaatacagctataccaactgcgttagtcattcctattgggtagatgatgcccttataaataatagcaactggaacagtgaaggaggaggaagcggcgatgtgtggattggaggaggaagttcaggaggttccggctcttcatcgggcactccggcaggaaatatattcaagaaagaggccgaccaagactcgcttttatgggtaatcaccgaaaacatgacagcccgaatcatggaagactgtttgggaggagacctatacagccaactgaaagagaaagtcaaaaacaacaaaatcaatctggaattcgatttcggcaaagggtattcctacaattgggaagagcataccttgcacatcggattggaagaattggaagcaaacaaccttctgcatgaaatgttccatgttttccaaaccacacaagagcctatatcatcgttcaaaagttctatgatgaacagagagatagaagcgcactatgcgcaatacctgttcttacaaaggagcgcggagtggacggacaaaaaacaagataaatatgcaaaaagccaacgcctaagagcaacaacttcattgactaaatatgtaaatcagcaaggtcatgttacaacttcattcttggatatctttgaaacctatatatctaataatgtcgttaatgctttccgtcaggaaggatacgacaattatccatttaaagagtattcggatatcaccaatatttttcccaacataaaattaacaactaaaaattgtgacgaatgaaaagactattgcttattacactgcttataggatacatctacccttgtgtagcacaggacaaacctatcagaacagaagaatcacttgaaggaacagtcatttataaaaagaccaccactttcgaggtagatggttatacgtaccaatgcgacgtagatgacggtagccagtttgtgactctttataacaaagaaaacaaactgacatacgaaaagattgtgtataaagacacggggaagacatatattggcagctggagtagcaatgtaattgaatatgacagattcatgagtcagcaagcagatttcatagtagaccaagcattcaccaaagccatggcagatgaaattgggaaaacggaacttatgataaccatgttgctcagtccaaatacgggagaagtaatggaagtgaatttcaattttttcacctttgagccatacgccaaagtgccactacatgtatatagggaaatcgaagtaaaactgaaagaacaaattcattttaaacccatagaggaaggaaaacaactcaactacattatgctggcatggatgcaaaagccccaagggaaactccccccattacctcctcccggttcgctaatgtaagcaacatacaaaattaacaactaaaaattgtgacgaatgaaaagactattgcttattacactgcttataggatacatctacccttgtgtagcacaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaattgtgacgaatgaaaagactattgcttattacactgcttataggatacatctacccttgtgtagcacaggataaacctatcagaacagaagaatcgcttgaaggaacagtcatttataaaaaaaccaccactttcgaggtagatggttatacgtatcaatgtgacgtagatgacggtagccagtttgtgactctttataacaaagagaacaagttgacatacaaagatattgtatataaagccacaggaaaaatatacatcggtagctggaatgaaaaaaaagtaattgaatacaatagctccatgagtaaacaagcagacttcattgtggacgaagcttttaccaaagccatggcagatgaactcggaaagcgtgagttcacaataaccatgctactcagtccggatacggggaaagtaatggaagtgaatttcaatttcacgacctttagcccatacgccagagtaccactgcatgtatatagggaaatcgaagtaaaactgaaagaacaaatacactttaaacccggagaagtgggaaaacaactcaattacatcatgctgtcatggagacaaaagccccaagggaaactccccccattaccacctcccggttcgctgatgtaacattgtaaaccaacctgcctatgcacgaaagaatctatagcagtttttttaaagttcaaaaaagaaatataaaagcttggcattgctgttaccttctgtgggtaaattacatatatttgtgattaacgacatcagagaggttacgaattatgtataagaacttattgaacttgcttgttttggcagtgctgctcccttcctgcaatggcactgcccctcacatttccgttgtatgcgaagaaaacaacgtgggcaactgcattgtaaaatgggaaatggcccctctcatcaaaggaaatgtgaaggtatatgcttcgaccaatcccaaccatatccccgaagatgttcccgttgccgtcgccaacatctccgacctgaagatgactgtcatcactaccgaccctacacaacgatactactacacacttgtattcgctgacaaataccgggtaaagattgccacccgcaacatcaacatccccggcatacagaacttccgagacctgggaggctattcctcctatcccacccaaaagaaagtgcattggggcatgctgtaccgctctgccgaaatagataaactgaaaccgtgttcgcgcaaagagctcaagaacataggcataaggactatcatcgacctgcgttcatctgtcgaagcgaatagacaaagccctttgcaacaggcattcaaagtgatccatatccccattcctaccggcgacatggagtatatcctgaaaggtgtacaggaacagaaaatcaagagcgatactgtctaccgaatcgtggagcagatgaaccgcgagctcatcagcaactacaccaaagaataccgccggattttcgatattctgctggacaagaacaattatcccgtcgttatccattgctcgtcgggcaaagggcgcacaggcatcgtatcggcacttgtgcttgcctcccttggagtggacgaagacatcatcatggaagactaccgcctcagcaacgactacttcaacatcccggcggcctcccgatacgcctaccagcttccggcacgctcgcaagaggccatcaccaccctcttctcggcacgcgaggatttcctgaatgccgccatcgaagaaatggaacgaaggtatggagataccgacacctacctgcaaagaggcatcggtctgacaaaagaagaaagaaagagactgcaagacattcttttaacggataattgacaatggataatggataatgagtagccaataaaaaacgattttatcatgtaattgcataattatcaaccatcaattatcaattatccattgaaaagcactatctttgcgcccgaaatataaagataaagatatacagaagatttaatgaagacatttgaagagctcggtgtgtcgccggagatacgccgcgccatcgaagaaatgggttacgagcagcccatgccggtacaagaggaagtaattccctaccttttaggagaaaacaatgatgtagtagcactggcacaaacaggaacaggaaagaccgcagcgttcggcctgccgctcatacagaagattaacgtcaacaaccgaattccccaatcacttattctctgccccacccgcgaactttgtttgcagatagcaggcgacttgaacgattattctaaatataccgatggcttgcgagtgttgcccgtatatggaggctcgtccatcgaaagccagatacgcgccctgaaacggggtgtacacatcatcgtagccacaccgggacgactgctggacctgatggaacgcaaaaccgtgtccctcgccaccatacagaacgtggttatggacgaagcggacgaaatgctgaacatgggattcacagacagcatcaacgccattctcgccgatgtgccgcaggagcgcaacaccttgctgttctccgctaccatgagcccggaaatcgcacgcatctccaagaagtacctgcgcgatgccaaggaaatcaccatcggacgcaaaaatgaaagcaccagcaacgtgaaacacgtagccttctgtgtacatgccaaagacaagtatgctgccctgaaacgtattgtggactactatccgcagatatacggcatcatcttctgccgtacccgcaaagaaacgcaggaaatagctgacaagttgatgcaggaaggctataatgccgactcgctgcacggcgaactgagtcaagcgcagcgtgacaccgtgatgcaaaagttccgcatccgcaacctacaactgctggttgccacggacgttgccgcacgcggcctcgatgtggacgacctgacacacgtcatcaactacggattgcccgatgacaccgagagttatacccaccgcagcggccgtacgggacgtgccggcaaaaccgggacttccatcgccatcatcaacctgcgagagaaaggcaaaatgcgcgagattgagcgcatcatcggcaagaaattcattgcaggcgaaatgcccaccggcaaacagatatgcgaaaagcaactgctcaaagtgatagacgatcttgaaaaggtgaaagtgaacgaggaggaaatcgccgactttatgaccgacatctaccgcaagctggactggctgagcaaagaggacctgattaaacgcatggtttcgcatgaattcaaccgtttcctggattactatcgcggccgtgacgagatagagacagcaaccggtagtgagcgtggtgcaagaagtggcgagaggggcgaccgcaacgaccgtagaagcagccgcaaagcagaacccggctttacccgcttgttcatcaacctgggtaaaatggacaacttcttccccaacgaattaatcagcctgctgaacaacaatacacgtggacgtgtagagctgggacgaattgacctgatgcagaagttctccttcttcgaagtggaggaaaaggaagccaccaatgtagtgaaggccctgaaccgcgccagctggaacggccgtaaagtatccgtagaggttgccggagacgaggataaggaggctccgaggggcaaacgtccgggtacagccggaagctatgggaaaaaagagtttgacagcaagaagcgcagctacaaggaagacggcaaacggaacgatgccaccggcaaacgcagcgaaaaggccgaaagtcctgcaaacgacaagaagaaaggcaagcccagccgcgaagagcggggttacaccaaagcccgtggcaaaaaggatgactggaaacagttcttccagggcaacaatgactttaaggatgcagagcccgacttcagtgaagaagggtgggcaagacggacaccgaagaagaaaaagtgatataaactatagaaagataatagggtgataaaaccggcagcatccgctaccgttttatcaccctatcctttttcacaactctttatcctttatttcgtacagcttttcgtattgaatgcaacgagcatccaaaccattttctcctgctctttcaagtagccggtcatcaaatctgccgtcacgtcatcgccggcttcatttgccagttcaattacctttctctcttcaccaatcaggtagccgtaagtctcgaggatatggtccacagcctcactgccgcaagagatgtcggacacttccttcacgttggcaaccttcaggtattcactgaacttattctcgggcacgccacccagcatcaagatgcgctctgcaatctcgtcaatcttctcggcggtatcgtcatacatactctcgaacttctcgtgcagcacaaagaagccgtgtcccttgatgttccagtgcataccgcgcagattggtgtaatgtacctggaagtcggccaataattggtgcaatgctgatgctacgccagccactttcttttcattcaaatgcaagtaatctaaagttttcataattctattgttttaaatatttatactatttttcttttgggtattgcaaagataaggggtaaatcaaggcttgtcaaacagataatttctatctttgcatagacgaactctatacataaccttcaaatgccttgttcatcatgactttacaacaattggaatacatccttgccgtcaaccagttccgccactttgccaaagcagccgaatattgccgcgtgacacagcccaccctcagtgccatgattcagaaactggaagaggaactggacacccggatttttgaccgcagccagcagccggtatgccccactcccgtcggtatccacatcatagaacaagcacagaatatattggttcaagccaaccgtataaagaatattatagaagaagaaaaacactcactgaccggcaccttcaagctgggcatacttcccaccgtagctccttacctcctgccccgtttctttccgcagctgatgaagaaataccccgacctcgacatccgggtagtcgaaatgaaaacaaacgacatcaagaaagccctgcagacgggagagatagatgcaggtatcgtagcgagtctggcaggtatggaagagttgcagcagacgccgttgttctatgaacagttctttgcctacgtgtcgcgcgaagatgccctcttcaacaacgaggtaatccgtacttccgacctaaacggcgaacagctttggctgctcgacgagggccattgcttccgcgaccagctggtgcgcttctgccagatgaagtcggcacgtgccagccagcttgcctatcacttgggcagcatggagacctttatgcgcatggtagaaagcggcaaaggcgtgaccttcatccccgaactggccgttctgcaactgggcgatgcccagaaagagctggtacgttccttcgccatcccctgccccacccgccaggtcgtgctgctgaccaataagaactttatccgccacacgctgctcgaagtgctggttaaggagataaaactttccgtacccaaggaaatgctctcactgaaagcaacccaagcagtcgtatagatttcatctatcgctccataaaatctttcaatcggattttttgttctatcggggaaaaatgctatatttttgcaaacagaaaaagcgaaggtcggttgcacctcagcatcatcaagcaaactggcttctacattctgtctgcacaatcttcgcattggtaaaacaaaaaactaaacctattaaaagagaaaaattatggaaccgatcatcaactcacaactccctgaattcaaggttcaggctttccaaaacggaagtttcaaaacagtatcccacgaagacgtaaaaggtaaatgggccattttcttcttctatccggcagactttaccttcgtatgccctaccgagctggtagacatcgcagagaaatatgaccaattccaagcaatgggcgtagaagtatattctgtaagcacagactcgcactttgtgcacaaggcatggcacgatgcttccgaaagcatccgcaagattaagtaccccatgcttgccgaccccacaggcgtactgagccgcgcattcggcgtgatgattgaagaggaaggcatggcatatcgcggcacattcctcgtaaatcccgagggtaaaatcaagattgccgagatacaggacaacaacatcggacgcaatgccgacgagctgctgcgcaaggtagaagctgcacagtttgttgccacacacgatggagaagtatgccctgccaagtggaagaaaggagcggaaactttgaagccgagcatcgaccttgtaggaaagatttgataagtaataggaggagcgggcgctttcaccatagaaagacgtccgctttcctttaagacgtccgcagtacttgtacagaagtactgtagtactttcaaaggagtaccgcagtactttcgaaggagtattggagtacttcctcacaagttctgcaactactctatatcaaacatattaaaagactattttctcaccccaaacaccctattaatcatgttagaaacaactatattagaccaggtgcggagcgtattccagcatttggaagcccgctacgtctttcacatcacctatcatccgggtcacgagcaggcacaagagcttatcggattcttgaaggatgtggcaagctgttccgacaagctctcctgccggatgagtgagatagagaaccccgtgttggagttcacattgctgaaagacgatgtggaaactggcatcaagttccgcggcatccccggcggacacgagttcacttccctcctgcttgccgtgctgaatgccgatggaaaggggaaaaatctgccggacgaagcaattcgtcgccgcatccgggcgttgcaaggcgacatcagcctgcaaacgtatgtatcgcttacttgcaccaactgtccggatgtggtgcaggcactgaacatcatcgcattgctgaatccgcacgtcacccacgagatggtggacggggcgcttaatcaagaggaagtggatgcgctgaagatacaagccgtgccgtcagtctacgctaatggcaagctgcttcacgtaggtcgcggttctttaggagagcttttgcagaagctggaagaagccttcggcagtgctccgcaagaggacgaagcaccgatagagagagatttcgacgtgctggtattgggcggtggaccagccggagcttccgcagccatctactctgcacgcaagggcctacgggtggcgattgttgccgagcgcataggcggacaggtaaaggagacggtaggcatagaaaaccttatctccgtgccgcagactactggtgcagaacttgccgacgcactccgcacacatatagagcactatccgatagagattttcgaggagcgtaagatagagaaagtaaagttgcagggaacggaaaaaagtgtctccaccgtaggcggcgaggtgttccatgcaccggcggtaatcattgccacaggggcaagctggcgcaaactgaatgtggagggcgaagcggaatacataggacgcggcgtggcattctgtccgcattgcgacggtccgttctatcaaggcaagcatgtggcggttatcggtggaggtaactcggggattgaagctgccatcgacctggcaggcatctgccggaaggtaacggtattcgaatttgccgatacactgaaagccgaccaagtgctgcaagagaaagcccggagcctgccgaatgtggaaatcttcacctcgtcacagaccgtaaaagtcgatggaaacggggaaaaagtaacttctatccgcatcaaggaccgccttaccggcgaggaacgcgacttcccgttagacggcatcttcgtgcaaatcggtttggcagccaacagcgctcctttccgcaacaagctggaaacgactccgaccggggagattaagattgacgctttctgccgtaccacacttccgggggtatatgcggcaggggatgtatcgaatgttccctacaagcagatagtcattgccatgggcgaaggggcaaaggcagcactctcggcattcgatgaccgtatccgtggagtgatttagaaaatatcacccataaaagtataggcagggggcacacgttaaggattggcaagcttcagttcctgaatcagatttcctgccttcccatacttctcaatcataaacagtatgtagcgtacatctaccccgatggtgcgctgcatcttcggctcataaaggatgtcgctgctcatggcttcccagttcccatcgaaggcaagccccagaagttctcctttggcattgaacatggcactgccggaattgcctcccgtaatgtcattattggagataaagcagacattcatttctcccttctcatcggcatatctaccgaaatcaccggaggaaagaagggatagcaactcaggctgcacttcaaaatccacatcgcctgcatgggctctgactttctccagaatacctttcgcggtggtataataatcatattccgctccgtcgaagggggcataaccgcagacagtgccaaaactcaaacgcatggtggagttggcgtcgggatagaagttacgggatgcgtacatacgtcgcacggcagagttgaacaaacgttcattccgctcgatttcaccggaagcctgctgtacctgcatattcatctcgaatagcttcgtgatgaggtcgatgcccaagttgatggcagggtcattatatatctgataggtggtgtcctgctccagaaaacgcttcaatccacggggggtggtcagctccgagcgggcataaagactatccacataggtacgctcgttacctccgtattctgtcgcaatcgtctggtagagctcgggcagataggtggaatccacttgggagcggtattctttcaacagtgctgtaaacacttccttgtcaatgcccaagtccagattggcatatttctcaacgatagctttcagattggcaaccaccgttttctcttccccctcaaagtcgaagttgaggatggacaaagcaagctgcaccagttccggaccgttcaggaaagattcggcaaagtaagctctggcacgataagcatcacggcggctcttgtagttcagctccaggtcggaaaaaagatgcagcagatgttcccgctcctccggtgtctgctgtatccagcgacggagttcggtctccatggcacgcttcttgtccagcacatgcagtttcttgatggtgcggttcactcctatgctgttcttccaataattggaactttcgtcgtatttggaagcgtacttgatgcggatgctgtcacggctatccatttcacgcttccagatggcctgcttcacaccacggacatctatctgagcctggttggtggtggtcatcatctcttcgatgccaaaagaggaaagatagcgttccgtactgcccggatagcccatcgtcatacagaaggaaccctcacgatagccgtccagggatatcggagccacgtattcgggatggtagggaacattgtcgggagagtagtcggcaggacggttgtctttgccggcatagatacggaatacggcgaagtcgcccgtatggcgtggccatacccagttgtcagtgtcccagccgaacttgcccactgaagaagggggtgcaaataccagacgcacatcattgtagtcgcgataaacggaaagccagaattcattgcctccatagtaagcatccacaatgcctatcagcgtggagtctttacgagaaacctcttcgccaatgaccagcatcaccgaatctactacacttgtacgctcagattcgttcatatccggttttactgctccaagtacccgacgggtcacgtcttgctggtgcaagaggaagcggacgtaaagttccggattaggcagttcttcactaagattacgtgccacaaagccgtctttcagatagtcgtgctccacagacgagtgttgctgtatgctgctgaagccgcagtgatgattggtaaacaccagcccgtccccggacaccaccactccggaacaaaagcctccgaagctgactaccgcatccttcagagacgggcgtttcgtattgtatagcttgttgacagacatctgcaagcccaactctttcatggtctggcgtgtctgcttgttcagatttcccagcatccacatcccttcatccgcttgtcccggcagagaaaaaaggaagcagacagctatcagtataaatcttattttcattccgtcaattcttgtattattcagtaatcagcctcaattgcttggcacccgtacgcgccttgagccactccgcaatcttttccttctcgtgcgcacccggatgcttgccgaatttcaagacggcaagggtcacagtatccacccgtacagaatctaccgccagttcaatcgcatgagatattgatacggtctttaccgacgggtagagcactttcagttctgggataatcttcttgcccaattcatcgaaggttttgtatctttccaaattctgctccagtgtggcaatcttctgtttctgttccaccagacgctgctcactgttcttgtagaagtcttccatcaccatggcacggatggaagaaatatccaccgcttcattgttcataccttggaggactatcagcttggtattgtccagcttatagtctttcatcttgctgcgggcaatggcgatggaagcttcgggcacctcctgcccaatcagcacgacacgtatttcgtggcccttgccctcgtgatggattttcttgtccagcacctgcgtattctcaaaggagagctgctcgttgacaaaacggttggcagcactctcaaagaaggtatcctggacgatacctaccgtcagatagacagcgggacacatggtcaggatagcaatcaggacaatatatttacgtactttcttctcccggttcttatccacaaactccttgcgctggaagtgcatcacgcgcacgcccaggaaagtggcaagactgataaacacggaattgatgaaataaagatagaatgcaccgaggaaataaatcaagttacccgttgccagcccgtagcctgccgtacagagaggcggcatcaaagccgtggcaatggcaacacccggaatcacatttcctttctctttggtagagagcgccgtcacacctgccaagccacccatcaaggcgatgaatacgtcataaatggtgggtgacgtacgtgccagcaattccgactgcccctcggcaacgggactcaccagaaagaaaatggtagcagtggtcacactgaacaaggtagttatcaagaagctcttcaaagaccgcttcatcaattcaaaatcattcaaccccacagaaagccccacgcccatgataggccccatcagcggcgagatgagcatggcaccgataatcacggctgtggagtttacattcaatcccaacgaggccatgaatatggcgaatatcagaatccaaagattggctcctttgaattccactcccttacggatggaatctacagtttccagttcattgtccttgtctttacgcaaatcaagatagtctttcagaaaagtcttgatagcgaaggtatttctgttgtcagaatccatgatatttacaatttgacgatttactattcagtagtttatttctttatcaaccagctgatgacgggtatgctgccgagaggcatatcacgccgcacgatataggccacaaagaccagcaacaaaacggtacggtacaccatacgcaggtagatattttctatcgggacatattctgcagccagatagagtactgccgcaagcagcacataactaccgatagccttcaggtcatactgaatgggatacttcttctgccctacgaaataggacagaagcatggcgataccatagccacagaatcctgcccaggcacaagccatataactgtatcggggaatcagaagtatgttcatcactaccagcaccgcgcaacctatcagggagaagtaggctccccaacgcgtttcgtcaatcagcttgtaccagaaggaaagattgaaatagatacccataaagatttcggcagccatcacgataggcactacccgcaatcccggccagtaatcagggccgatgatatagcgcaaaatatccagatagaacatgacagccaggaatgccagcagtgtaaagatgatgaaaaacttcatggcctgcgcatatacctgcttattgtctttgtcccggctctttccgaagacaaaaggctcgtatgcatagcggaaagcttgtgtaagcatcgccatcaccatagcaattttgctggcagctccataaatgcccaactgcacagtagcttccgcctcatccggatagacaaaaggaaaaataatcttatcggccacctgattcaagatacccgccaagccaagtaccagtaacggcagactgtaagcaagcatccgcttcaacagttttttatccagcacataagcaaacccgcgtaactccggaatcatgcaaagcataatggtagaggtgcatatcagattgaaaaggaaggcatagcccacgtcatcccctttcatccctacataatagaccagattcagtgctatattcaggaagatgaacagcagtttgagtgccgcaaacttaatgggacgcttcttgtagcgcaaataagcgaaaggaatgctttgaatagcatccatcgccaccacaatcatcatcatgcccacgtaccagggatgctcactgtactccatccatccggcaatagggtcgagaaacagcagccccaatgcaaggaaagtaagcgcccccatactcacactgagtaatgtcgtggagtacacacgcatcgggtcatcctcccctttattggcaaagcggaagaaaccggtttccatgccgcacgtcaataataccagcatgagggccacccacgcatatacattcgtcactacgccatagccgccactctgtgcggacatcgccatggtatatacgggcaccagcaggtaattgaggaaacgccccacaatactgctcagcccataaatggcagtttcttttgccaatgattttaatccggccacttctttttaatgattaatggttagtgattaatgattaatgaatcactcgtcgccaaacaaggtacgctggctactatagagactccgccccaaatgcttgtaggcaagctccgtcacttcacgcccacggggggtacgtttcaggaaaccctcttttatcaagaacggttcatagacttcctctatcgtgccggcatcttcgcccaaagcggtggcaatggtggtcagtcccaccgggccgcctttgaacttgtcaatgatggtgcagagtatcttattatctatctcatccagaccgtatttgtcgatattcagggcttcgagggcaaactgtgcaatttccgtatcgatactccccgaacctttcacttgggcaaaatcgcgtacacgccgcagcaatgcattggcaatacgcggtgtgccacggctgcggctcgcaatctcggtggcagcccttacggagcaaggcacatcgaggatgccggacgaacgacggataatgccgctcaacacatcatcatcgtaatattccagatgcaggttgataccgaaacgggcacgcaacggagctgtcaacagaccgctacgcgtggtagctcccaccagcgtgaaaggattcaaatcaatctgtatgcttcgggcagaagggcctttgtctatcatgatgtctatgcggtagtcctccatggctgagtacagatattcctccactacggggctcaaccggtgtatttcgtcgatgaaaagtacatcattgggctccaggctggtaagcactcccgccaaatcccccggcttgtcgagtaccggaccggaagttatcttgaaacctacgcccagttcgttggctatgatattgctgagtgttgtttttcccaatccgggagggccgtgaagcaacacatggtccagcgcctcgccacgcaggcgggcagctttcacaaatatgcgcagattgtccaccaccttgtcctgcccgctgaaatcctcaaaattcaacggacggagagcgttctcgaaatcacgttctcggctggtgacgggctgctggttgcgtatatcaaaatcttcttgttccatactatctatcatataacttattcagccatcctataaaagcttttgcttcttctgcatccggattcaatatacgagcagtaatagcttgtccgataggctttcccggttcatcctgccatgccaagaacgtatgtatttttgccttggagcgatgcacttgcttgtagcgttgtatcccttctgcttccaactctgacagcactacttcaactttccgaatcaaaaggtcttctgccggaatcatgttcaatgcaaaatcctccaacatcccctcaaaacgattattgggcataatccaaatacctactacagcgtcatagtcattcaacggatacaagaccagtccgtcagaaggcaaatctaagccatcacagtcatatttattactggatttcaaaatatcaaccaattgcctccagcgtttttccacatcagtatcagcatccagcacaacaccgatacgaggatatgccgatggattagtaagtgtcagcctgaacagcccgattgcgttctctacactctcgcaaactttgatattgaaattctgattcacatgatgtagtccgcataaagacgaaactacatgaaggtcatttttcccttcaacgaacaaatgatagggcaagctcttgcttaatttactcatatcctatcgtatttcaacaccattttgtgctataaattccatctccttgtcatcgctatagttcacagcaacgatctctcctccccggttgtccaagcgaattatctgacctccccggttcacagctataaaactattgatacaatcgtgactatgcgaagtggcaaatacctggacattcagtttttcggaaagcatgaagataactctccacaattgggtctgtaccgtatagtgaagccccgtttcaaactcatccagcaagaagacgccacctttgcaattgaccaacgcaagaattacagtaagaatccggttaatgccgtcacccatcgaactcaaacgaacacgctcgcccgtatctttcaaagtgacaaaagggacacgcctattggaatattcattctcattcaagaagttcagccggtcaatacttggttcgatgatgcgcagggcatccaaaacataaccttctctatcggatagagagatacggtcgaaaagcaatacattttttctaagatgaaagtcttgtgccaatacgtactcaaacggaactctgtcctttacattgcccggaaagccacgtcgaaagaaaggtattagcataggggcattcgagcctgagaccacactcaaaccatcacctatgtaacgaaataagtgttcgcccgaatcagcatcgtcatcattatagacccaacgtacaattgtccctcccctctgttcctcggctatatgtacaagtttgatattcagtaggtcactctgttcgccaatggaaatagccgtggcattcctgaaatccatcttacgcccggaaaacaaggagctgtaatgctccgacaatacttggctgaaatccacatcccctttagcggaatctacattcaccatttcccctctgaaatccaaaatcgttttcagccattcgtcattcccgtttgccaaataaatggaaacagcttccagcaacgtagatttacctacattgttgcaccctactattaaattgacccgagcaagcgaatcaatagacagctctcttaggttcttatagttcttgatatacaatgacttcatactccaaagctttttgtctactgcaaaataacgaatttattttgagatagcactcatcccctttcttttttcacataagtaaagggcgtatgacatacctggcacgctccatacaacggaatattatgctgctcggaggcaaattacagaaaaaacgatagaagtagcaagatatatacttgaaatatatttgcaggttcacactttcttcctacatttgtgtaaaataaccagccatttactgacagcaaaccaaatctacccctgctgaaagcacaatgcatagaacacgctacttatgaaagaagaaatatcctttacccaagtccccttcgactaccccttgtgcctcaacggtcaatgccccaaggctgccacctgcctccgccagctcgccatgcagagcatgcctaccgaaaaggattactggaaaatcatcagccccaaacgccttgccaccgtcaaaggggaatgccccttctaccgctccagtcagaaggcgcgttacgccaaaggcttcatgaacatgctgaacagcctaccctacaacaagcggggaatcgccatcgccaacctgatagccggcttcggccaacgcacctactaccgcgcccgcaaaggcgaacgcctgctgctccccgaagagcaacaatccgtactgaacgtcttcagacatctggatgccggcatggctacagaatttgatagttacgcagaaggctacctctggtaacgcactgaccatcagagactaattttgccaactctttgcctcacctttggcaaaactttgccatgcctatggcaaaagtttgccaacgcggtggcaaagtcttgccaataaggtggcaaaaacttgtcaacttgttggcaagaagagcaaaatacagtttaacgattttcattccccatcagcgcttcataaactccttgcgctcctcctccggaaacttctctatggcatagcgcaacatcgttcgcggcatcgtcctgcaatacttctccaagaattgtaccagcaagtccttgtcccgcttacccatctcccggagcatccatcctaccgccttttgcatcaagtcatgcttatgatggagcagccgttccgaaagggctaatatatcgatgaaatcaccatttttgataagagtataggtagataccacagcaatgcgctggtcccaaagcagcggactatccgccagccggtagaggtctttacgaagtttgtctttcaaatattcgcccacaatgccgggggcagacaaatcgaccaaatcccaattattgatacggcccgtttgcgaaaggtaaaagtcataaatctcctttttccccttttcatcgctctttttgaatcgctccaccaacatcagcaaggcacaaaggcgacactcgtgccattcactctgaagcaaggttgccattaccccaaaaggttcgtgcttgtgctgctttgccacctgccgggtgttgggtaccaccactcccagaaacttatccccctcgccatactgcccctttccggtcttgaagaaacggggaagatactcccttttcaccgggtcgatatacgcctccaattcctgctgaatctgtaccgagatgcacgccacttcttctgccgaaagcacacgttcgcacaagacggtttccactgcttcattcttctttttcatccttctctcatttgatttacacggatttgaattcatccgccaatggacaaaaatactacatttatatagaaactatggaaagttatctttaattttgcaaccggtatgtccaatccttaaaaccgtacgacatgtataaagctgttttgggagcaatctgctgcctttctttcgcactatccttacatgcacaatctccacaagaaaaggggttgcaaagcatcagccgcacttcggccaaggctattgtcggctttctggccgacgatgagctgcaaggacgcgaagcaggcatgcacggttcacgactggctgcccgctatctggcatcctgcctgaaagaagccggcattgccccgctggaaaaggacaattattaccaacccttcaaggcttacaacaaggaacgccaacaacggggacggtggcaagtgcatcccgactccatcgccatccttaaacaaggcgtccaccgcatcctgcagatgagtaatgtattgggaaccatcccgggagaacgaccggatgaatatgtcatcgtaggtgcccacttcgaccatctgggtgtggacgagacgctggcaaacgaccggatatacaacggtgcagacgacaatgcctccggtgtctctgccgtcctgcagatagcccgtgcatttcttgccaccggacagaagcctctgcgcacggtcatctttgccttttgggatggggaagaaaagggattgctcggctcaaaatactttgtacaaagctgtcctttcatcagccaggtgaaaggttatctcaatttcgacatgataggccgtaacaataagcccgagcagcctcaacacgttgtctacttctacaccgccgcccaccccgtattcggcgactggctgaagcaggacattgcacgctacagcttgcgcctgcaaccggactaccgcgcctgggaccgccccacgggaggaagtgacaatgcttcttttgccctgtgcaacatccccatcatctggtaccacacagacggacatcccgattatcaccagccttcggaccacaccgatcggctgaactgggagaaaatgatagaaataaccaaagcagctttcctcaacgcctggaatcttgccaacgaaaacaaatattaatccattagaaacaaagtaacgatacatggttttaaattacatctgggtagcattcttcgtcatcgcattcatcgtggccctctgcaaactcatctttatgggtgatgtggagatattcacagaactcgtcaactccaccttctcctcttccaaaacagcttttgaaatatccctgggactgacgggaatactcgccctctggctcggcgtgatgaaaataggcgaaaacagcggcatgatcaatgccctctcccgttggctgagtccggtattctgccgtctctttcccgaaataccgaaaggacatcctgccatgggttccatattcatgaatctctctgccaacatgctggggctggacaatgccgctaccccaatggggctgaaagccatgaaggaacttcaggaactaaacccgaaaaaggatactgccaccaatccgatggtaatgttccttgtactcaacacttcgggactgatacttatccccgtcagcatcatgatgtatcgctcgcagatgggtgccgcccaacccacggacatctttatccccacactgataacgaccgccatctcgaccattgtcggtgtcattgccgtcagcattgcacaacgcatcaacctgctgaacaagcccatacttatcctgattggctgcatcagtcttttctttgccgcactcatttatctgttcacacagattagccgtgatgaaatgggtgtatattccactttaattgccaacatactgctgttctccatcatcctgctgttcatcctctgggggctatggaagaaaatcaatgtatacgatgcctttatagaaggagccaaagaaggctttaccactgccatacgcattatcccttatctggttgcttttctcgttggaatcgccgttttccgcacttccggcgccatggatatactggtgaacggtatcggttatgtagtaggactattcggtgtagataccagttttgtaggtgccctgcccactgccttgatgaagtcactgagcggcagcggtgccaacggactgatgattgacaccatgaagcaatatggtcccgattcattcgtcagccgtatgagctgcgtggtacgcggtgcttcggatactacgttctatatccttgctgtgtatttcggcagcgtaggtatcaccaaaacgaggaatgccgtgacgtgtgggctgattgccgatttttccggcatcattgcagccatcatcatcagttacttattcttcttttaaaagaactagcttaatcgcaagaacgtaatttcaatcgtacatcgtaaatcattaaatcgtaaataaaatgattagttatcagacagacggcgtggaaatgccatccatcaagaagcgtgaaaccacggaatggataaaatccgtagccgccacttacggaaaaagagtcggtgaaatcgcctacatcttctgctcggacgagaagatactcgaagtgaaccgccaatatctgcaacatgattattatacagatatcattaccttcgactattgcgaaggaaaccgtctcagcggtgacctcttcatcagccttgataccgtacgcaccaatgcggaacagttcgccgataacaactacgaacgcgaactgtaccgggtcatcatccacggcatcctccacctttgcggcatcaatgacaaagggccgggagaacgggagattatggaggaggcggaaaataaggcgctggcgatgcggtaaatccaaagaataaaaactctgtcttgataaagtgctgattttaccaagacagagtatttaagaaaaacaagttactttgccaacacaacgacaactaacgggtgatatttgtctgctcctgattcgatgcgggcatccacaccatctatagttactctaataagttcaacactgccataaccatcattgtacttccaatgggaaataatggaatattcctctccgtcaccaaagatatagggacaaacaaacgtacgcctcaatacttcaggcttcttgtcatatttatatccatcccataaaggcaggctatgcctgccttatatttatttcttcaccgagaagcgataaatgcaatgactgtcatacttctctcccggcttcagcaatgcagaaggccattccggcttgttgggcgtatcgggatacttttgagtctccagacagacagaagcacgatgaccgtacacaatacctttctttccggtcagtgtgccatccaggaagttaccggcataaatctgaatgcccggttcgttggtatagacatcaagcacaatacccgttgagggagattcgagggtggtacacgggcgggtgacatcgcccttcgtattgagtacccagttgtggtcatagcccttgccgttcttcaactgctcaaagtcattgtcgatacgggcgccaacagcagtaggagtgcggaaatccatatccgtaccttctacggaaacaatctcaccggtagtcatgaaggtactgtccacgggggtataagcatctgcatcgatagtgagcagataatccgaattggacttggaggggtcaccgtccaggttaaagtaagaatggttcgtcatattgacaacagtggtacggtctgtttcggcactgtaacgaatgtcgatggcatcgtcatctgtcagcgagaaagtgaccttgcaggtcaggttacccgggaagccctcctctccgtctttcgacagataagtcagttccaaaacctgattactcaactggcgggcatcgaacacttgatattggtatcccttgggacctccatgcaggcaatgaccgtaattgttgcgcggcagctgatactctaccccatccactgtaatcttaccctggttgatgcggttggcataacgtccgatggtagcgccgaaatccgaagggaacttgatgtagtcctgaatggaatcgaagcccagcaccacatcacgcataacgccatccttgtccggcaccatcactgatacaatacgtccaccgaaattcgtaatacaaacttccataccattcttattctccaaaacaaacaagtctgtctgcttgccatccacttccgtacggaagttcgcaggttccagtccagaagcagtcttttcactcgcctgtttgcccgtgcaagccgatgccaatagcatcacgcttgccaacaaagtcatcatcttattcataaatacaatattggttactgtttagactatcattttttcaacaagaactgctccgcacgtcccggagtgaacaactcccacaaagaagcgaccgtccagcccggagcgaagatattgttgtaatatccctttccgttacgtccgtaatcccaattggtatgctgcaccacttccgggtaatagcctactttggcaatgccgcacatgtgtccttcatacggcagtaactggcgcatggaagtggaaatcacctcggcaaagtcagagaagcgcggctcgttgtactccttggagagccaatgcagcacatcggcaaattcgaagataaatacatcgatatggttattctctaccgacacatttccccaaccacgggttttcaagccgatatctcccagcatctgaccttcggcaaaaggaacatcccaagtataataccacgacaaagcaaaataagcggctttcttcgccagaccggcatagtgcgcacgctcttctcctttggtaaccaaagccagataataagcagccgtagcagcatacaaggaggcttccttgtcctcgcagttggcatccagcgtagaagagaaataatcggctttggatatcagttccttctccagatagtctaccgtatgcttggcgcttgccagataacgtttgtccttgaaatacttggacgccatcaccaaaggcaatgttgccgaaggcgtgctaccgccgctggcatccacgatagagaaatcatccttgaacttgcgcgggaagctgccgtcctcgttctgcaacttgaggaagctgtccagcatgcccttgatgcgtttctcccattcggggtgtttacgcttctgctgtttctcgtagttcaaatagttcaagatggcatacactccctcggactgacggcggatgctatgtctagtttccttgaagccgcggttgtagtgcaccacttcgttgaagaaaccggcaggcgaaaaaccgttctggagataagtgtcaaagatatggttggcattgtccaccaggtcttggcggttctgctgtttgccatactccaaagcattgaaagcgttcagcaacgtacgtcccacaaagcccacttcggcaacatcggtattggcacaagtagcagtctccaactctacaccggaataataatgagtgggggtattgccaacatagctttccacgaagaagttgctcatcacctccttcatgcggtctaccgtgtaaggtgtgtcaaccggtttcggacggttagtgtcataacaatactcccaggtgcgctgtacgcattccgagaaatcggcagcattcctttcggacacctcccaagtcatggagatgctgtcacccttacgaagcaactggaaagcctcaacggcaggagccagcgtcaatttgcggatatatgtcttcggtgcttccttataggggaaaccgtatgccaagacagtcacaccatccacattgcagaaaccggtatatccgatggaagtctcaccggacaagattatctctccctccttatgagtggtcaaagcttccttgtcgaacttgtcaatacggataaccgacatggacgtaccgcttaccggattgaaagctgccgtcagcggagtgctcaaacggtcctcacgcaccagccaactgtccgatgtgtggaaagaaggagcttccttcggcgaacgcaggttgcggcgataccagaagcccggcatgtagaactggcagtccgaatgcttgtaaccggtctttatctgttccccgtagttgaaatacacattttccagcgccttgagtgtgacggtaatgcgctgtttgccatccttgtccaccacctggcggatgatgtccaacggcaacgtttccgaagcccggcagctgtacataccatcctgcatcttctgcaaggccagcggatattgcttggcatcattccccggcactttcaaggaaatagaggcagagatgtcttccggagcagcatttgccgctcctgcacccgtaatgcccaccaaaagcattacccccaaaaacaatctttttagtctcatagttacatctgttttattgttgttatataattagcttcttatttttccgacgcattgctcaccacctgcggacgaataatgtcaccgccgatagagacaactccccggtccgaaatggcaaaatccttgatatacgaagtgcgcggctgtactttcgtggaactccaatgtgcatggaagatgtatttccagctaccgtccttgcaaagaaaaggtactccgtgaccggtacccatcaattcgtctacacgttgcagaatggggtttcccacgtatttcgtccaaggtcccatcgggctgtccgaggtggcgtaacccactccgtagttcttgctttcaaagtgatttgccgagtaaatcagataatagatgccgttcttcttcagaacagagggaccttctgccaccttggcgggcttgtcctgcgagagctcccacggctcttccgccttgatgcactccgtcagcgtttcctgcttgatgccagtcaaatcatcgttcatctctgccacccaaatgacgttgccatctgtaaagcgcacgaaataaaggtaaggcgtgccgtcatcatcaatgaacagagaggtatcgatgctcttctcaccccatatcggctgcttcacctcctgacggaacggcccttggggcacatctgccgttgccacgcagatatgttcctcggtggaataaaacaagtagaatttatttttagacttgatatagtacacctccggtgcccaaaatccccacgtaccgtaggaattggcagccgacagtgcctgcccctcacgcgtccagtttttcaagtcgtcggaagagaagcaggcaaagccctctccttccaccgtaccgccggtgccgtaggcataatacttgccttcgtaaagcattacgtaagggtcggcaatgggcagatggtcggactctacaaccagcttttccttgcaccctgcaaaacaaagacaaagcaatagcagcaatatataattcttcttcatgtttatatcttataaagtatcctatttagaaactgctttgattttctaaattattatcttgtattaaatgataattataaagatttcgtttaaaatgataacgatgtcttggtaatggcaacgggtcctgcaaacgcaattcccaagccaacaattttgtcagcaactcgctctgcttatctatcaacttgggatttccaaataaattattaatttcatacggatctttcttcaaattgtacagttccccttttccataactattcataatcagtttccagtcacccatacgtaccattcgagaggttccactttgagtccatgtattcagttcgtcaaaatgagccaccttattgggtcccagcgcaccttcctgctcaaaagtcaagctatcgtccaaaggaacatcttctccgccaaaacctaactgtacaacaacgcttgaaaactcttctttcggatattctttacccgtcaacataggccataaactccgtccctgaacacctaccggtattgaatcacctatcgcagtacaaaaagtagggaaaagatcggccaacgaaacatgcgcatctatagctttaggctgcttctttatctgatagcctgcccaaaccatcggtattctggttagagactcagacaagcctactcccttacgaattagtccgtattcaccacaataatctccatgatcggacagaacaacgatgatagttttctcgaatagtcccttttccttcagatcctcaaccaagcgtttgatctgatcatcaatgagacgaatcatccccatataatttccacgtaaccgaggcaggtctctttcaagattaggacaagaagcgtcttccagttccgccagaatctgatacttttctcccttcttcaatacatccttccgtgaagtcttcacagccggaatcttatccggtgcaaacattgaataataaggttcacaaacctgatacggattatgcggttcagggaatgaaatccatacaaagaacggattgtccttctggctatctatccattctatagcctcatccacaattctcgtaggttgctgatctttcaaaggtataggcgaaggttccagatactgcccgactgcctctttaaagaatttggaaatagcacgctctccttccgtcaccggcttattcttcccccagtgagaatattcagaccaaaaatccatatcctttgagttcagataagcatgattcttacctactaaagcagttttataatgattctccttcagaacggttaccaagtctttcgcataattaatgtcacgcacattgtgattggtacgtacatgagttgcagttggaaaacggccggtaaacatggaacaacgtgcaggagtactggccggcataaccgtatacgctttatcgaaccaagcgttctgatgtgccaattcatcgacaaatggagtaatatccataggaaaaccttcacgtccacacaaatcggcacgttgctggtccgtcattatcactacgatattaggtttatctgtctgcgcaaacaaagacaaacctattccctggagaacgattcctgagaaaagatgttttataaacttcataactatctgattttaattaataaccatataaaaaacgacacatactccataacccctataaagagattatgaagtatgcagagactcaatcacatcaatcccaacccggattctgcaccatattaggattcatttgcatttctctcgccggtatcggaagactccagtaatgatctcctccccaggcataattattagttctggttccccatatctgagtcataccattcatcttgccttctttgtccttatagaacttcagatctttccaggttctccagcgaatctcatcgaaataaatcacgtcttcacctattaattcccaatggcgttcgttcatgatacgctggtgcatatctgtttttcctgtaacctgagtaaattcgttggttcccagtaattgggcacctgccctttcgcgcacctcattcactttgcttatggctccgggaagatcattcaactcattcaatgcctccgcccaattcaacagaacatccgcataacggataaacggcaaatccaattcagaatatatattcggcaactctaatccttcacccacaaacttacgatttaagtaatagaacttcaaacttgtatctgttttcaaatccccatatgtggtataagaacggaaaggataacgcatcacatactctttaggagttccttcaaccccaccaagaaaagaggcataaggggttataacggacattgccattctcggatcacggttttcataggcttttttaatcctctcctcgttaccggaagcatcatatttggacatatcagcccccgcagctactgcgttctttctttcagtctccgtgatattattccgcaggaaatacaccatacgcttatcaatgcccatatcattatatccggggataatgtcatcccaattgaacttactaccgtctctattttcgtaagactcggcaaactgcgggtttataatataattattccatcccaatccattgcctgaagggtcaggcggcaagcatctgttaccgaaacctctgttcttcttttgcgtataatctggatgatccagacattgcaaagagaatatcatttcatcgcaacgctcattttccaccttaaacagtttcttgtatgactcctcacccgcacctttataaagcgtgtatccacaatcctttactgcctgaaaatcatcagccgcctttttccattctttcatccacagatataccttgcctcttaaagcataggctgcaccttttgtaatatgcccgtaattggcatcatccgaactgtatttatccggcaaatccggattattgatacaggaagtcagatcatccactatatatccccagacttcatcctgagtggaacgtgccagttttgcctcatcaatatccttaatcggatttttatagtaaggaactccattatacaagatattcagcctgtaataccaccagcaacgcagaaacatacattctgaaatatagcggcttcttttagtctcatcaaatccctcgaccgtaggcagattgccaatcacatcatttgccttgataattcccttatagaatctttgccagggagcagaactccccttaacagagctcggagaatttgtcgcaaataagaaattgaaagtaggagctatacctataccgtaatccatagtactggaccatatatcaaaccatccattggcaacatcgctataatccacatacagttgattatacacacccgctatcgtctgttccgccaaggtaggagtcgaccatacattcccttccgccggctttccattgggtgacaaatccatatctacgcaacctgcggttgacattcccacaaggaccactgcggccatcgttttcatcagatttcttcctttgtttatatttatcttgttcataccatttaattttagaaagtaacatttacaccaaaagcatattgtctcataggagcatagcccactccactcatcatttcaggatcaatacctttgaacttagtaatcgtcaacagattctctcccgaaacataaacacgcacattttgcatacacaccttctgtacccaatctttggggagcgtgtagccgactgtcagattcttcagtttcagataattgccattatgtagaatatgctggccggaaacacttacctgagctgctttatccatggtgagacggggatttgccgaagtaagatttgtccgcgggtcattcggattctcaggatcgtaaaagtaatggtcataagctacatctttacctattccatacccaaaccaggttatactactattctcaccagactgataccagttgattttgaatccggcagcaccagcccaattcatagagaagtcaatgcctttccatgacaggtttgtctggaagccgaagtaatacttcggtgttttagaataaccctggaaatccttgtcatcgtcgtcaccataaatgccatctccatccaagtctgcataaatgatatcaccataccagatattactcttgccgattccctgtttcggatagaacttatatccggcattcgtcatggcctgcaaccatttcatatcatcttccgtacggatcattccgtcagaaggccctcctttcggatttaccgtaccgtcggcattaaaatagtttctattgcctttatatacgttcagcacataaaattcattgatcatgtgcccttccaaaacacgctgcaagtctcctgttgaaacctcacccaaattggtataataagtggaactaccatccgcattctgctgccatccgcggacaagttctcctttgtatttggttacttcattcttgttgtaagagaagtttccggatatgccgtacgagacagaaccgatccgatcattccaacctaaggttatttcaagtcccttattagtaacctctgcaatattctgtcggggagaactgaacccagacaaagtaggtgacaaagtgggattatacaagataccgtccgtcaacttattataaacctccactgttccactcaaacggtttttcagcatagagaagtcgatacccaggttggtaaccgtagttgtctcccattccaagttatagttggaaaaacttcccatgcccagtccaggaacctccttgttgccaaaagcataatggggagccgtagcataaacagcctgccattcatagttaccgattgagttatttccgagtcgtccccaggaaacacgtagtttcaggttgtcgagccaattcagcttcttcatgaatttctcttccgacaaacgccaccctgccgaaaaggatgggaatataccccagcggttctccggagaaaaacgggaggaaccgtcataacggacattcgcctcaaataagtaacgggaatcatacgtataagtaacacgaccaaagatagaacgggatgaaaactctgtagtgcttccatcaatataatcaggctccgtcaatgcgtcaaagtctgtaaggctggtatcaagcattcctttcttactaatgtcggtagtacgtgcccatttgcggaattcctcatagcccactaaggctgccacatcgtgtttacctttgaaaatctgtccccagtttaaggtggtagtatttttccagctctgatttccatcaatataatatttcacagggtactccgcaagcaattcggaagtaggaggaacattcatagtttctccacgttggaatgaaaatctttcctgataatcggaataatgccacagattctcttgccgataatgatcgtagtagaagttagaagtcaaatggaagttcttaaggaaatcaatcttaatataaggattcacaaagaatttcgttgttttataagagcctcccgcactattcagataataaaccggattgttgactaccggatcttcttcgagggcttcgggagctccatatttcccatcgtaatacggataggttcccggtgtacttttctgcatttgcaaaccattcaaatcatcaacattatttctttcctgatctacatgataaccccatgcattcagccccacagccaagaaactggcaacctgtgattccagattactgcgcatataatatttcttcattcctgaattcaccaccaaaccggggttatccacatacgtagcattcaggctataccgggttctcttttccgcaccggtaagcgtaatagaatgttcctgcatcaatttcggattatacacctcatcataccagtccgtattcggataggccacataattcggatagcccgattcggatattccattcggattactggccgctgcacgccacgtatcaatggtagtttggctaaacacctgtgcctgccctgcattgtccgaagcctcattgataaattccatgtagtcggcatagtttgaaaccatacggatcagattagccggtgtattataggagaattttcctgaataggtcacgttgattttcccgtccgtacctttcttggtagtcaatagaataacaccattagcaccacggttaccataaatagcacacgaagcggcatctttcaggatggagatagaagcgatatcattaggattgacattattcagcgacatttccattccatcaaccagcaccaatggtgcagaatcatttaaagtacctgtaccgcgaatacgcagagtagatgattccgagttgggcttactggatgtctgcatcacattcaatccggccaccatacccgataaagtagaagcaagcgtagttacgggacgcgacaaggtcttatcatcaaaattaaccgtagcaacagagcccgtcagattcacttttttctgagagccatagcccaccactaccacttcatccaacaattcgttatcggacatcatccgtatatccaagacactctgattgccaaccactatcgactggcttttatagccgatatacgatatctccaagacatctcctgtagccacagacaatgaaaacttcccatcaacatcggtcaccgtacccatagaggctcctttaaccagaatgctgacaccaataagagcctctccggtatctccgtcgattatacgtcctgtaatgttccgttcattttttgtttgatccaccgaaaggatagatacgtgcaccgtttcatttgccaaagaagacgatcccaccgcgttcgcagaaagactccccatatatataagcgaacacacgaggaattttgtatttacctgcataagatttaaagttttaattaaacactgttttttcttcataaatccaattccattcgacaaattctcgagacattaccaaatgaaatttttcacttcaaaaataatccataaatacaactataaatgcaacaaaacaatcatttcataaaacaattggagcggatatatacatcaaagcattgttgatacaaaaattctaatacttgattatatagtttcatcatttcacgaagtctttgggcagaataccgaattgtttttggaagcacttggtgaaataggaaggagtattgaagccggtcatatagcaaacctcattgattttacactctccttcctttaaaagctgcgccgctttcttcaaccgctccaggcggatgtagtcattcggggtcatatccaatatgccctttatcttccggttcaggctcgaccggctcatgttcagcaggcttgccatatcatccaggcagaaatccggattctgcatattggcaaccaccacttccttcaatgttttaaggaaagattcatctgcctttgtcattgccatactgcccgtctgcacaaagggagaattgacaaaagaagcccgtagcttctcacggttgttcagcagattggccacacaaactttcagatattccacggagaaaggtttctctatatatacgtcagcccccagcttcattccctctattttggcttgaagagtcgtcttcgccgtaagcaggataatcggtatatggctatagtcaagctcggacttcagatgctcgcacagctccaatccatccatctcgggcatcataatgtctgaaatgacaagatttacagtatgttccttcaacaccttcaaagcttccaccccattcacggcagtcagcacacgatattccgaagagagctgtttcacaacaaatgcctgcatttccagactgtcttccaccaccaaaagagtataccggtgctgttccaaggcagtacctgcaccactttcctcagaggattccccgcccgttaccggttctttatgctccatagccaccgtctgctcgtgcttcagcggaagtgacagcaggaaacagttgttctccatcgaatcttccatgcacaacgtaccctcatggagttcggccaatgaacgggcaagtgcaagcccgataccggtgccgggcacagagcgcagcgtaccggtcttatactggatgaacggcttgaaaatctcctcgcgcatctctaccggaatgacaaggccgtcattgcatacggaaagcagcagcctttcaccttccgagtacagcctgatgcgtatataggtctccgaatactttatcgcattggtcagcagattgctgataatcttggtaagcccttccctgtcaaccgaagcatacaagctttcgggagtctctatgctcaatgccagccctttttcgcgtgccagaggcttgaagcgcttatacgtcttctgcaagagctcagacacgtcgcattccacaaaattcaattggaagccttgcgtctccgtcttccggaagtccagcaactggttcaccaaatcgagcagccggttggtgttcagttccatggtctccaaatcatccctgatgtcgtccgagacagactgggaaaccaatacattctcgagcggactctttatcagtgtaagcggtgtacgtatctcatgcgccacattcgtgaagaagtctatcttcgcagtatacaactcccgctccttttcccgctcaaacttgtccatagcctgctgatgcttctgccgggtctgttttctgaaatagatgattacagcagccagtgagcataacgccaataccgtataaccggcatatgcccaggtggagagatagaaaggaggacggatatggatgtcgagcacacgttccgtagcgttccacttgccatcgctgttggaaccttttatacgcaacgtatagcttccataaggaaggtttgaatagttgatgatggaattccgtcctaccgtataccagtcgcggtcaaaaccttccaacttatattcaagactgttcatttcgggtgcttgataacttaaagccgcaacctggaaagaaaaggagttctggtcggcatccagttctatttcatccgcataggtgatgctcttctccaaaggagaatccggactgtccaccgaaagccgtttattgaacagaaagaagtctgtaatcaccacgggagggaggaaagtgttctccacaaaggtttccgggtcaaaggctatgaatccgttgatgcttcctaaatagatgcgtcctttcttgtcgatgtagccggactggaaattaaactggttgctcagcagcccgttggccgtggtatagacatgcttgctctccgtatcgggattgaagcagaccagaccatgattggaagtaatccacaagttgccccgcttgtcctcgaccatcttgtagatggtattgctcggaaatcctttcgacatgtcataacgggtaaaattgtccgtttccggattgtagcggcagaagccctcacccagcgtcatgaaccacagacgcttcctgctgtcttcgtagatactgattaccttattgtagggaagagaggtcgaatcattctcattagacagataattcctccactgctggcttcttacattgtagcagaacactccattagaaaaagtagcaaaccacagatttccgttgaagtcctccagaatgttataagtaaacatattcttcagctgaggaatccgggtaaagtcatctgtagagcgattgtacttcaacagaccggacgtggtgcctatccacacgtctcccgtagtggtcctgcaaatggtaaaggcgtcattggcgaccatggaattctcactctcacccttgccataatgtttcacctgcctggtccgaagattcacccggttcagaccaccggagaacgtacctacccacaaatcatccccgtccaggcaaaggccgtggacattctgataaatggccggatgctcaaaaggctctatctttccgttttccggattgtaattgaacaagcctttgtcttcggtacctatccacaaggtgccatcattactttcacagatttcccgtacacgacggccgaaatgcctgagattgtctctcggatagaacttctcgaaataagtccactgataagggcaatagttcactccaccgaaataagaccctatccacatgccgttctccttgtcgcagcagagcgaataaatggcattgtccgacaatgcatacgaatcatcctggtcgggaacggtcaaatgggtaatcttgtcattcgtcagattgtaaatatacaagccggactctgcgcccacccacagctcgttgtcagatttgaactgcaaagccctcacataggtgttcagcagcttccgcgtcttgccggtagtctggtttatctctgtcaacccgttcagcgaagcgatatacacacaattatggggtccgctgacctgccagttgataatatcattcttgaaaatctcatttccttccgcatccttgaaaggctgcagaggagtttcaaagtcagctttcgtatagtaaagattatccgcatacaaggccagccaacacgtattcccattcagccaaaagcgggttacattgggcagtcccgaatcgtgcagatggttcagcagcctcccttcatccggtttatagcagaacaacccctggttttctaccgatatccagatattgtcgtcctcgtcacttccaatcatggtgacgaaatccctgatgatactgccattatcactggcctcatcgaaagcggtaaaggaatccagtaccgggtcgtaaataaagactcccccatcggtaccaatccagatattgccccggcggtcctcgtagagcgcggttatgaaattcttgcctaaaccggagttctctttcttgtagacacggaaagacaacccgtcataccggttcagaccgtccttggttccgaaccacataaagcctttcctatcctgcaaaatctgatacacggtgttctgcgaaagaccgttccggatatccatcgttctgaaatagtaatgaacagcatcctgcgcacagaccggcaataccgcccataggcacagactaaggaaaagctttataatcaatcgtttcataacaacatttttaatgcacaatttaccatttacaaagtacaatttaactatgcagatgacagcgcagccaaattgtactttgtaaatggtaaattgtaaatgcccctatttcttaagtgaattgcagatacgtgtatttatctctttcacgcgtttctcatccagctttatcaccttgcggtcgtaagtcatcagaccgttcacttccacctccacatccgtggtctgtgtatagacggctgccgagaaacctctttttatcatctgatacagcatatcggcatatttcacgtactcatcagtcacttctttggaagagttgaactgaacatatccccagttgcggttcggttcccaaagatgatctttcaagacaaggccaatgccgccatactcacccaaaaccgtggcgcgctgtgcatcatacaaatacatttccggttggggatagttgtggaggtcgagcatgtcaccgcaagtataatggttaccgccacttgccggattcaccaggcgggtcgggtcatactgtttcgtccattcggctatctctaccgtcttgaactgcccccaggcttcgttgaacggtacccatgtaccgatacacggataagagtagagacaatccattatttccttccattccttgtgataataggcttcggattcggtggagcgtttcagttctgttccgtcgaaatagcggcggttctgccattccggattacggtcaccgctcggcatatcctgccatacgatgatacccaaacggtcacaatgtgtgtaccaacgtgccggttccaccttgatatgcttgcgaatcatattgaaaccgaaatctttcgtcttctgtacatcatacagcaaagcctcgtctgtgggagctgtatacagtccgtcgggccaccaaccctggtccagcggtccaaactggaacaaagcctcgttattcagttccaggcgtacgatgccatccgcgtcacgacgggtggagtacttacgcatggcagcatagctgtccaccttatccactaccttgcctccacttttcagagtcactttcagcgtatagaggaagggggaatctggactccacaacttggcattccggggcatggacacctccaccggctctgcattgatacttttgccggtggctaccagttgattgccgtcatacacattcacttccacaaagtcggaagggcatgcactattcaattcagccctcactgtcaacagattacggtcaatatcgggagtgatacggagattctcgatatgttttccggcaaccggctccatccataccgtctgccagataccgcttacgggagtataccagataccttccggattgctgacctgctttccacggggttgaggtcctttatccgtcgggtcccaaacctttacgaccaactgattattgcctttgccagaaagggcggcagtaatatcgaaggagaacggagtaaatccacccgtatggctgcctactttcacatcattcacccatacatccgttttccagtcgacagcaccaaagtgcaacagcacttgttttcccttccaggcggaaggaatatcaaaactgcgctggtagaccagttcctggttttcattgattctttttccaactccggacaaggaggattcgatggcaaaaggaacaagtatctgcccttcgaactctgccggaagatgctcacctttatttataacggcataattccacagtccgttcaagttcttccagtcactccgttccatgatgggacgaggatattcgggcaacacattcgcgggattaatctgggatgcccagtccgttttgattttatcacctgccggcttccattgcgccgagcttccgattgcaaacaacgccaagaatgacgatatgaggaaaaatcttctcatagtattataactttttattggtttctacgaaagcaaagataagccgattcagaaaaaaagaatagaaatttcgaaccaataaatagtatttttgtggaatatcaaggtattaccgtctcattttatcaaagaaattcatcaaaggcacctttttccgcttttcttgccacgcctatgacaaggttttgccttcccattggcaagactttgccaccgcgttggcaaaactttgccataggcgtggcaaaagtttgccaaggcagtgacaacttgttggcaaaatacctccctgatatacaaggagtagcaaacaatagacagcagggaacgactaatatcccggattctgctggttctccaatgccggattggcatttatctcatcttgcgaaataggaagcacaatcttctcgaaagtacggtcgattgtttttccacggtgactcaccggaatatcttgaaaatcgtcgttgaattcgatggttctgcccatacgcatcatgtcgaagaagcgttgtccttcaccaaaaagctccttgctgcgctcgtccagaatcatatcatcggtaatggtagcggcagtggccggtgccagtccgggagaacgcctgcggatttcattcaggtaaccggcggcggcatctgcgcctgcttcctgcttcgtggagtgcaaggctgcttcggcggcaatcagatatatctcggaaagacggattatcttgatattgacggctgtattggttgccttgccgtcacctgccagagtggtactgcccatatacttgtagcaggctcccttgcgttcaatctcattgtccacccagtattcatcgttgtccatgattccccaacgcacatccgtctcgtcttcacccagacggttcaagaaataatcgctggcaagataccagcccatggcattcttcaactgtccgtagcgcatcaggtaaaagcccaaagaagaagttcccaggtctgattcctcagtggtgatgcccagctcaaagatggactcggaaccaaactgcttgctccaggaagccgtccaatcggcaggctcatacagtttgtacacaccgctttctataatctcccgggcagcgttcaaagcaccgtcataatcttccatatagagtttcacacgcgcttgcagggctatgttggtgtaatagtccgcatatccgctctgctttgtcttcttcttggcaagcagggccgccccgtccgacaagtcctgcagaatctggcgatagttctcctccacagtagcacgggtgggctgggcgttcaccgtaagcggctcggttacattgggaactccataagaggtcttgttgtaattgtaaggaagcccgtagagacggaccaaatcgaaatagaacagcgccctcagagtcaacgcctgccctttggcttcggaaaagtcttccatactgcccgattcttccagcttctcaatgttgctcaacaaggtgttgacctgcagaatgcagtaatatccacggctccagaaaccggaataagtattgctgttggaagtgtggttgaacgtatagaatgcatccagtccgcgtccggcagcaaaaatcgtgaggtcaccgcccttggcatcaccgtacataaaaaggtttctgccgtaataggacgatgaggtcatcgcactcatcacaccgttgataaccacctgcgcatcggctaccgtaccgacagcaccttctgcatttccggagttggtgggctgcatatccagaaaatcgtcacacgaagtgaatgtaaaggcaccaagtatcacaagtgccaataaatgatatatctttttcattgttagttcctccagttcattaaaatttcaattcaacgccaacgacaaacgtttttccgataggggtttcccaaccacgtgtgccgtattcgctcacttcggggtctgcctccttgtatttggctattgtccaaaggttgctggcagtgaagaaaaggcgggcattctcgatgaaagccttgcgggtcatggctttgggcagcgtataggccaatgagagattcttcaagcgcagataactggcattgaacaagtggcggctgctgtattgttgcgggtcatcgaggtctacaccttcgatacggggctctgtaccgttcgtatggtctggcgtccaaaggttgttgtagtagcttttagcacggatacgctcccaataataaccgtcgtcggccacatccatgtaggctccgtcgtacaagtctcctcctatcttataggtaaagcccaacgaaagggctatgcctttgtaggagaccgaggtattgatgcccccatacactttgggaacggcattgccgatgatggtgtagttggcattgttatagtcataagtagctccgcgcccgttatactcaaaatctccggccttgccattcttggggtcatttacatagtagacgttcttgccgttggtcttgtccacacctgcccattcgtatccatagaaagccagcgtggactgaccttcccggtatacatattgcgcacggctgtcgctactggtggggtcgtaccagataatgtccgcaccgccatacaactctttcacctcagaacggaggaaggttgcgttggcaccggcactccataaccatcctttactatcaatgatgtcaccactcaactccacctctaccccatggttgttgatgcatcctacgttccgcaacgtagaggaaaatcccgtaaccatcgaaatgggaacatcctggagcaggttcttcgaatcacggttgaagtattccaccgtaccgcgcagacgttggccgaagaagccgaagtcgatacccacattcgtgttgtagctcgtctcccaagacagcttgtcattggtgacggtagtgattgtaccgcccgggttacccatgtacttactggtatagctcatcaagctcatatagccgtaattgtccgaaggcagcgtaccgttaataccataagaggcacgtatacgcaggttgctcaggaaagaatatttgctcataaaaccctcgcgcatgatgttccacgctcccgccactgaccagaagtttccccaacgttcctgcttgctgagccgggaagaaccgtcgcggcggtaagaaccggaaatgaagtagcgttcatcgtaattataatccaacttggagagcacggacaccatcgagtttccccaggaatatccggcagaagtctgcgttccggcagtagaaactgtatgaatggtgctgaccgcaagattgcttcctgtggcacgcacatagtctgtcttgttcttctccgcttcgaaacccaccatggtgccaactgtgtgtttgtcgaaggtgccggtataattggcggtagtggaggtaaccatcttctcgtatgtagtacggtattcgttgacattcccattgtctgccgagcctttatagtgattggcactgtaatagatatggtcttttacagtagtattgtcgtaagagtagatagaacgaaggtccaggcccggcatcagatgcagggtgagcgtctccgcagctatgattttggtactggtagaaccgttctcccactctttgtcataataaagcccattgtaggcgtagctaccgtaacgttcggtccagagctcgccggtcttgtaatcagtgggccagtagagtccccacagcaagttacgggtctgcatgaagtaattactgcccgtgttgcgtgtatcattataaccgcttttcttggtacgcgccaggctggcattggtggtcagttcaaggaatttccccaccttctgggtgaggttcaggcgaccggaaacacggtcgaagctgttcatcttcaaacgtccttcgtcctgggtataggaaagggaagtgtaatagttggtattctgcgtagcaccgctgacggacatatcgtaggtctggtaaatggcggtacggaaatatgccttgtcccaatcgtagtatttgcctccacgcccggagttgtcgtactcaaggatattgacgttctcgtaagctcccgtaccatttgtggtaaattggtagccatgtttgttgaaacggctgttcaactggcctatggcataggctgccgccttttcgtccgtttcgcccttaccacttgtacgggcatcgtgaaatacggtgtagagcatattcacattctcctgtacgctggccgtttcatagttgtccgttgcccagcagggcgtgaagcccacttcggctttcagcgtcaccaccggcttgccaatctgtccttttttggtagtaatcagaatgacgccgtttgccgcacgcgacccataaagcgagctggccgccgcatctttcaatacagaaatagattcgatgtcttccgggttcaacgtattcatgatgttgttggtagaatagagctcaccgctcatctgccccgtattgcccgaagagaccggaacaccgtccactacatacaacggttcattcccggcattcatagaacctatgccacggatgcggatggccggtgcggaacccgcctggccggaattattcgtcagttgcaagcccgccactttaccgttcaacgcgttttcaaagctggtcgtcggaatgtctttcagcgcatccgctttcactaaagaagccgaacctgcatagctgctctttttggccgtgccgtaagccaccaccatcacttcatccagcagttccgaatccgatttcagcaccaccttcatagcaggctttatggcagcttctactttctgcatacctacaaaagagacaatcactgtctttgccgtgcccggcacattcaagattgtaaatttaccttcgatatcggtcacggcccccagcgttgtacccttcaccaataccgatgccccaataatcggctcattgttgtcctcggcaaatactgttcccgagaccgtagacgtctgagccatcactcctgcccccataaccaggcagacaatgattaacaagaagaatttctttctcatgcttctcttccttaaaattagtcaatcaaaacactttttaatatccaaacgctgcaaaggtatgtatctttttcaaaaagaaaagcaatagtattcaaaaagcttcattttgattgtattttaagctaaacacaagcaatatgtctatagcctaagcattccaagcaataagtatgatgctggatacggaaatataagcaatgccaaagaagatatatccggattttaagatatgacacgtcccggcatacaacttttttcgtaactttgcacagttttaaaatacactgaacgaatggagtttaagtatgacgttattgtaatcggcgccggacacgcaggatgcgaagccgctgccgctgctgcaaacctgggttcgaagacttgtcttatcacaatggatatgaacaaaatcggacagatgagttgtaacccggcagtgggaggcatcgccaaaggacagatagtacgcgaaatagacgccttgggaggatatatgggattggtgacagaccagacagccatacagttccgtatactgaaccgttccaaaggtcccgctatgtggagcccgcgcgcacagtgcgaccgcaacaaatttatctgggcatggagagaaattctggaaaatatccccaacctgcatatctggcaggataccgtgcaggaaatcctcgttgaaaacggtgagattacgggagtagtcacattatggggagtaacgttccatgccaaatgtgtagtactcaccgcaggaactttcctcaatggactgatgcacgtgggacgtaccatgcttccaggtggacgtatggcagaacctgcatcctaccaattaaccgaatccatcgcaaagcatggcatcacctttggacgcatgaagacgggaacccccgtacgcatagatggacgcagcgtgcattatgaggatatggaaatccaagacggagaatgtgacttccacaagttctcgttcatggacactcatgtacgccatttgaaacagctcccttgctggacctgcttcaccaacgaagaagcacaccgcatcctgcaggaaggtctgccggattctccccttttcaacggacaaatccaaagtatcggcccacgttattgccccagtatagaaaccaagattgtgactttccccgacaaaccgcagcaccagcttttcctggagcccgaaggggaaacaacccaagagctctacttgaatggattctcttcttcattgcccatgaacatccagattgcagcattgaaaaagataccggcgttcagagacctcgtcatctaccgcccgggctatgccatcgaatacgacttctttgaccccacccaactgaaacatacgctggaaacgaagaatataaagaatctgttctttgccggacaagtaaacggaacaaccggttacgaggaagcagctggacaaggaatcatggcaggtatcaacgcccacatcaattgccacggcggagaaccgttcacccttgcaagggatgaagcatatatcggcgttttaatcgatgacttggtaacaaaaggtgtggacgagccttaccgtatgtttacttcccgtgccgaatatcgcatcctgctccgtatggatgatgcggacatgcgactcacggaaaaagcctggaagctgggactcgccaaggaagagcggtacaagctgctgacagaaaaacgtgaagccgtgaaccggattatagacttcgcgcggaattactcgatgaaaccggcattaatcaatccggtattggagcagctcggcactactccactgcgccaaggatgcaaattgatagatttgataaaccgtccgcagataacgattgagaacattgccgaacacgtcagtgcctttaaacgagaactggataaaatatccgatagaaaggaagaaattgtagaagctgcagaaatactcatcaagtacgagggatacatcggacgcgaacggattattgcggataaattggcaagattggaaagcatcaagataaaaggtaagtttgactataattccattcaatccctttctaccgaagctagacagaagctgatgaagatagatccggaaacaatagcccaagcgagtcggattccgggagtatctccaagcgacatcaacgtgctactggtactttgcggacgatagagcgcaaagttccacgtgaaacaaagaattcaataaacgtattaaataaactgattatgagcaaagaaactcttaccaaaagcatccgggaaatacccgacttccccattccgggaattctattctacgatgtaactaccttgttcaaggagcctaccgccttgcaggaactctcggacacactatacgagatgtataaagacaaaggcatcaccaaagtagtgggtatagaatcaagaggattcattatgggccccattctcgccaccagactgggggcaggcttcgtacctatccgcaagccgggaaagcttcctgcagaaaccattgaagaaagctatgataaagaatatggcaaagacaccgtgcagatgcacaaggatgccatcaatgaagacgatgtagtattgctacacgacgacttgctggcaaccggtggaacaatggaagccgcctgcaaactggtgaaacagatgaaccccaagaaagtgtatgtaaacttcatcatcgagctgaaagagcttcatggcaaggatgtgtttggagatgatgtggaagtggaggctgtgctgtcgctttagccatttcatatttcaccacagattacacagattaacacagattatttatccaccacaaaacacagttttatcgaagagaaatctgcgctaatctgtgtaatctgtggtgaaacgtcggtattatggaagaactcagaactaacgactacctcaaagggattgtatccaaccttcccgaaagtcccggtatttaccaatatctgaataccgaagggactattatatatgtaggaaaggcaaagaatctgaagcgaagagtgtcttcctacttcaaccgggagcacgaaccgggaaagacgagggtgctggtcagcaagattgcagatatccgatatatcgtggtgaatacggaagaagacgcgctattgctggaaaacaatcttatcaagaaatacaagcctcgctacaacgtactgttgaaagacgacaagacgtatcccagcatctgcgtgcagaacgaatactttccacgtgtattcagaacccggaagataatccgtaacggttcctcctattatggcccttacagccatataccttccatgtacgcattactcgacctcatcaagcatctgtaccctttgcgtacatgccacctgaacctctctccggaaaacatacgtgccggaaagttcaatgtttgcctggaataccacatcaagaactgtgcaggaccttgcatcgggaagcaaagccaggaagagtatctgaaaaacatcgctgaaatcaaggaaatactcaaagggaatacccaggagatagaacggatgcttttccagcaaatgcaggaactggcagccgaaatgaagtttgaagaagcacagaagataaagaagaaatacctgctgctggaaaactaccgggcgaaatcggaagtggtaagcaacgtgctgcacaatatcgacgtgttctccatcgaggaagacagcgatgaaaagtccgcttttgtcaactacctgcacattacgaacggtgccatcaaccaggctttcacctttgaatacaagaaacgattgaatgagagcaaagaagaactgctctctctcggcatcatcgaaatgcgggaaagatacaagagcctttctcgtgaaatcatcgtgccttttgagctggatatggagctgaaagatgtcgtctttaccattccgcaacggggagacaaaaagaaactgctggaactctccatcctcaatgtgaagcagtacaaagccgaccgcctgaagcaagccgaaaagctgaatccggagcaacggaccgtgcgcctgctgaaagagatacagcaagagctgcacctggaccgcctgcccatgcagatagaatgtttcgacaactccaacatccagggttccgaccccgtggccgggtgcgtggtcttcgtcaaggggaaaccttccaagaaggattaccgcaagtacaatatcaagaccgtagagggaccggatgactatgcctccatgaaagaggtcgtaaaacggcgctatcagcgcgctatagaagagaaagcacccctgcccgaccttcttatcaccgacggtggaaaagggcaaatgagcgccgtaaaagaggtgatagacgagcttggcctgaacatccccatcgccggacttgccaaagatggcaaacatcgcacttccgagctattgtatggctaccctccccagaccatcggattgaaacagaacacccccctcttccgactgctgacgcagattcaagatgaagtgcaccgcttcgccattaccttccaccgcgacaagcgcagcaaacggcagattgcctccgcactggacgagataaaaggtatcggtgaaaagacgaaaagcacgttgctcaaggagttcaaaagcgtgaagcgtatccgcgaagcatctgccgaggagcttgccgccgtggtgggagaagcgaaagccaaaatcatccagacctatttctcagagaaataatgactgataaatcagcctgcagagccatgcacacaacgaattaattcgtaactttgtcccctcaaaaagacaagaacaacatgagagtagtgatacaacgtgccggacacgcttccgtcaccatcaacggaacctgcaaagcctccattggaaagggcctcatgatactcgtaggcatcgaagaatccgatggaaaagaagatatcgactggctttgcaagaagatagtcaacctgcgcattttcgatgacgaaaacggcgtaatgaacaaatccattcttgaagcagacggcgagatactggttatcagccagttcaccctccacgcctccaccaagaaaggcaaccgtccctcctacatacgggcagcacggccggaaatatccgtcccgctgtacgaacaattctgccgggaactgagtttagcattaggtaaagaaataggtaccggcgaatttggtgccgatatgaaagtagaactgatgaacgatggtcccgtgaccatctgtatagatacaaaaaacaaggaataatgacgttagaagaagcacagaaacaagtggattcctggataaaggaatacggagtgcgctatttcagcgaactcaccaatatggcgatactgaccgaagaagtgggcgaactcgcccgcgtcatggcacgcaagtatggcgaccaatccttcaagaaaggagaaaaagacaatctcgacgatgagatggcagatgttctttgggtacttctctgccttgcgaaccagaccggagtgaacctgacagacgccttctgccgcaacttcgagaagaaaaccagacgtgaccagacaagacatatcaataatcctaaattgaaaaaccatggagaagaatgagcctacccagagtaagtatgacgccgccctggcaaagtacaacacccaactggatgatgcagaaatagctgcacaagctgccagaatcattgcagagaaagtaccggcaaacaatacaccggaggtaaagaaattcctgttcaactgcattgaccttaccaccctgaagagtgaagacagcgatgaaagcgtcatgaaattcacccagaaagtgaataaattcgacgaagagttccccgacctgaaaaatgtggcagccatctgtgtataccccaattttgcagaagtcgtaaaagacacgctggaagtggaagatgtaaaaatagcttgtgtatcagcaggtttcccctcctcccagactttcattgaagtgaaagtggcagaaactgccatggcactgatggaaggcgccgatgaaatagacatcgttatttcggtgggcaagttcctggcgggagactatgaaggcatgtgcgaggagatacaagaactcaaagcaacctgcaaagagcaccacatgaaggtaatcctcgaaaccggagctttgaagacggcttcgaacatcaaaaaagcatccatcctttccatgtattcgggtgccgatttcatcaagacttccaccggcaagcagcagcctgccgccacgccggaggccgccctggttatgtgccaggccatcaaggaatatcacgagctgacgggtatcaaggtaggctttaagcccgcaggaggaatcaactgcgtgaacgatgcactgatttattacaccatcgtcaaggaagtgctcggcgaagaatggctgaacaacgagctgttccgtctgggaaccagtcgtcttgccaacctgctgctttcggaaatcaagggtgaagagatgaaattcttctaagagaaagctgtatttacctataaataaagcctgatggagtgggttccatcaggctttctcatattatcaaccggaaacagttccgtcatttttcccgctctaccacataatccagatacccggctagcgctgcttttacctccgtatcgggcaaagaagccagcaaagaaagagccttttccttatagtcatacatcacttgcgaagcatactctataccaccattctgcttggtaaattcgattaaatgggctatttcgccaggcgttgcctccccattctttatctttacggcaatttcttccgctgttttatccttcacggtattgagcacatgaagcgcaggcagagtcaacttcccctccaccatatcatttccggtaggtttgcctatttccttgctctcggagtaatcgaaaatatcatcctttatctgaaaacaaagcccgatatattcaccgaacagacgcgcagattccgccttttcatcgctggcccccaccgagagagcgcccgccttcgtacaagctgcaaagagcacggccgtcttcttgcggataacgtcgaaatagacttcctcggagaaatggagattgctgacgttggaaagctgcagaagttcaccatctgccaaatcctgccccaggcaggagacgatgtcgataatgtcatggttacgggtcatgcccacttgcaccaacgctgttgcaagcagataatcgcctgccagtacggctactttattattgaaaatggcattaacggagagttgtccacggcgttcagtactttcgtccactacatcatcgtgcacaaggctggcattatgaagaagttccaacgcaaccgcagcatgcagggttgcaggacataccttgccaaaaagcttcgcagccagaagcaccagaatggggcgcatcatcttcccgttcttctgccggatatgcgcaattacgctgttcagcaaaaggttggaactggagagggtactttcaaaaagcttcttgaagtcctccaattcctcagaaatcggagattttatcaatgatgagttgtccatgcatcgctatttgcctacaaaaatagtaataaaacggttaatacggtatttttttgtacttttaccatgaaaaaaaggattaaatgtatgaattcaatcgataaactgtttttgctcgatgcctatgcactgatatatcgagcctattacgcgttcatcaagaacccgagaatcaattcaaaaggattcaacacttcggccattctgggctttgtaaacaccctggaagaagtgctcaaaaaagagaatcccacacacataggagtagccttcgacccgtcgggccccaccttccgccacgaggcctacgagcaatacaaggcacagcgcgaagagacacccgaggccatccgcctttccgtacctattataaaggacgtcatccgcgcctaccgcatccccatcctcgaggtggcaggctacgaggcagacgacgtgataggcacccttgccaccgaagccgggcggcaaggcatcaccacctatatgatgacgcccgacaaggactacggccagctggtatcggaccgcgtctttatgtaccgccccaagcacactggtggattcgaagtgatgggtaccgaagaagtgaagacgaagttcaacatacagaccaccgagcaggtcattgacatgctgggactgatgggcgatgcttccgacaacatccccggctgtccgggtgtgggcgagaaaaccgcacagaaactgattgccgaattcggctgtatcgaaaacctgctggaacataccgaccagctgaaaggcgcactgaaaacgaaagtggaaaccaaccgcgagatgataaccttctccaaattccttgccaccatcaaaacagatgttcccatccggctcgatatgaattcgctcgtccgcgaagaaccgaacgaagaggaactccgcaagattttcgaggagttggaattccgcacactcatcgatcgggtactcaaaaagggaagcggcaattcgtcctcccctactccaacctctccggtacccgacctctttgccgggactctgtttgcccagccgcaaacctccactcccgaaaacagcgccccgattcaaggcgatttgtttgcaaattttgcgggcgaggggacgggcgtttctgaaaattcaaacctgacgcggttagaaatgctcgatgtagactaccaactcattgatacagaagacaaaagagcagaaattattcaaaagttacttacaatcgaaattctctcaatagataccgagactaccggaaccgagccaatggacgccgaacttgtaggaatgagcttcagcgatgccgaaaaccgtgcatactacgtacccgttcccgccgaacgagaggaagtcttaaaaattgtaaacgagttccgtcccctcttcgaaaacgagaaatccatgaaggtgggacaaaatatcaagtacgatatgattatcctccaaaattacggcgtccaggtgaaaggcaaacttttcgacaccatgcttgcccactacgtgcttcaacccgaactgcgacacaacatggactatctggcggaaatctacctgcactaccagaccatccacatcgatgagctaattggagcgcgaggcaaaaaccaaaagaacatgcgcgaccttccacccgaagatgtctaccgttatgcctgcgaggatgcggacgtcaccctcaaactgaaaaacgtgctggaaaaggaactgaaggagcaaggtgccgaacatctgttctacgaaatagagatgccgctcgtccccgtacttgtcaatatagagagcaacggagtgctgctcgacacggaagccttgaagcaatcgtcccaacacttcaccgtccgtctgcaggagattgagaaggaaatctacgagatggctggcgagacattcaacatcagctccgccaagcaggtaggcgaagtgctcttcgacaagctgaaaatcgtggagaaggccaaaaagaccaagaccggacaatacgtcacttccgaagaggtgctgcagagctaccgcagcaagcacgacatcatcgggaagatactggaataccgcggactgaagaagctgctgagcacctatatagatgccctaccccagctcatcaacccacgcacgggacgcatccacacctccttcaaccaggcagtgaccgctaccggacgcctcagctccagcaatcccaacctgcagaacatccccatccgcgacgaagacggaaaggaaatccgcaaggcgttcatccccgacaccggctgcgagttcttctctgccgactactcgcagatagagctgcgcatcatggcacacctcagcgaagataagaacatgatagaagccttcctcagcggacacgacatccacgccgccaccgctgccaagatatataagatagacataaacgacgtaaccgccgacatgcgccgcaaggcaaaaacggcaaacttcggcatcatctacggcatctccgtcttcgggcttgccgaacgcatgggcgtttcccgccaagaagccaaagagctgatagacggctactttgaaacctacccgcaagtgaaggagtatatggacaaaagcatccaggtggcacgcgagcagggctacgtggaaaccatcttccaccgcaagcgcttcctgccggacatcaactcaagaaacggggtggtacggggctatgccgaacggaatgccatcaacgcccccatccagggaagtgccgccgacatcataaaagtagcgatggcacacatctatcagcgcttccaagcttacaatctgaaagcaaagatgattttacaggtccatgacgaactaaatttcagcgttccagaggctgaaaaggaacttgtacagaaaatcgtaatcgaagagatggagcaagcatatcgcatgcaagtacctctgaaagccgattgtgggtggggaaacaactggttgcaggcacactaaaccacccaataactttatttaacttacaatcagaaagcaacagaagcaatcctttcgaaatacagtttgctcatcagaatatccggcaacctcactgccggatattttttattcaccaatcttgccaaaaagaaagcataccgaagccctcactactgacatattgataaaatttaatatgatatttatatttatgtcaatttaatacgtacctttgcagcgaaatcaatgacatattgatagaaaatagaaagttaaactaaaaaagacataaaaccatgaaagcaaaagtatctttaaaaacagtgattgtttcagcacttctcttagtttgcggattaaatgcctcagccgacaataagagcaacctcatttacaattcggaagaagtaaatggcatgaaagtggcagagaccgtatacaagatggacggaaacacgcttgccaactatatgaagtacaattataagtacgacgaccagaaccgcatgacggaaagcgaagccctgaaatggaacagcaccaagaatacatggggcaaggacatgtgcatccgctatgcataccaaggcaagacgatgactaccacatactacaaatggaacaacaagaaaggcgaatacatactggttcccgagatgacagtaatcatggacaaccctaacatgtaattgacaaactctctcttaaagtaagaaatcttattcctaacaacaataaccgaaaccttttataaaagagccggaatgattcgcacattccggctcttttattatatcttgaaaaacaaatcctttccgtcagataccaataaccttacacgattagtatcctggattgttttctataatggcactgtttgtatcaatctcactttggggaagcggccaaagttcatcctttcctttgatatacttcatcgtgttatacacacggagattcagtgctttcccatcccaagaactaccctctgaatatgccggatgccagttgtcatcaaatgaaggcttggcattggacataagccctttttgattgggagcataaatcttacctgtcatcactgtagaagccataccccaacgacggagatcaaaccaacgaaaaccttcattacaaagttcaacagtacgttcgtaacgtaatgcctttcggagtccgctctgcgaagtaactaccacatcgggcattcctacacgattacgaattatattgatgtccgttcgtgctaactccagattgccatcagccatttcaatattggcttctgcctctattagataaacctctgctaaacgcatcaagccgcaattaagatcactggtttcatggttggagattgcagctctttccaactcggctatatccaaatatttcctccagagatatccagcaggacctttagtgccattggcaccgtatacgcccttggttccctgtgactccatgtttgtcacgtccttgcccgtgctatagtcgtgaatctttttactggtagtggaagtctggaattctagattgaatatgcgtgaaccaggtcgcaaacagaaaagatccagacgagggtcccggttttgccaagggttctgccagtcatacagagaagattccgtaatcgatttgccatccttgcattgaaacatatcaacaaatgtttgtgtaggaccaaaataggcgcatcctcccagtgtacgtggagccatgtaatatgcctccttggttttattactggatattaccgcatcatactgcacggaccagagccactcattgcttgcctcaccgtcataaccaaacagagccgtctgaccggttggctctcctgcctcatgactttctccacaatactgtgtattgatggattccaattcaaagcctgcctccttagccaaattcaaggcttgtttggccgaactggcagccaagtcatactttttccaattcaaggcaatacgggcacgtaacgcatacgctgctacccgtccgatgcgtgcactgccatagctttctgctttatggcggagtggaaggttagccaaacactcgtcgctaagatccgaaagcagattctctacaatggtctctctcggtgtacgtggggtctggctgtcatttatacccgctgtgtggaccacatacggcaagtctccatagtgctggcaagcttgatcataacagaatgcccgtatgcacagcagctctgcccgtatactctctatatccgtatcagaggctgtgccacgcagattatccagcgcatcgagaagctggttgatacgtgccacggtcttatacacgcaattataaagcttgtttgccaccgcgttttcagcagaagctccggaggtgattaattccgtatacatagccgtgttgacacgtgtagcaccaatatcggtaatattgtctgtcaccttccaccaggtggtggtgctggcactataagctgtcagagatgagtaaacagcgttcaaaccgaaattcgcctcttccatactcgaaggataagaggaagaagacggtgaagtgagtggttcaaggtcgagtgaacaagcaccgagacctaatagagacagcgaaaggagtgctgtataaatattgtttcgtttcatatcattttttctttttatgtcttcttgaatacagacggtttccctattccggctaatcagaatttgatgtcaacgccaaaagtgaaggctttcgtctggggataattgtttgccgcacccagagataccccatctgttgctgatgcgttatagttgacttcggggtcatagccatcccaaaagtcagtaaaagtcaagagattctcagcattggcataaatgtaggcagacttcagtccgatggctttcatccacttggagggcaggtcgtaacccagctgcaggttcttcagacgcaggtaagcggcactcttcatccagaaggatgatgtataggtgttgttactgctcttataagagaggcgaggcgtggatgcatcatgattctgctccgtccaatagtcaaggtgttccttgcggtaggttcctccctgatagcaaggcatcacgtagtaggaattgagataaccgtcggccttgccaactccttgcaagaaagccgaaagacgaattcctttgtatcccactcctaaattaaagctataactatagcgtggaactgtacttccgataatcgtcttgtcatctgtagtaattttgttgtctccgctgacattccggtatttcaggtcaccgggatatacggttgtaccgaattggggacagttggcattgatttcgtccgcttcttcttgtgaattgatgaaaccgtcgcatatcaatccgtaaatggagttaatggaagacccctcttggttacgaatatcaccgcttgtgctgcttgtgccccgcatgtcggtgatggtgtttttcacgtcgctcagcgtaagggcggcatccagcgaaaagtccctcgtcagcttcttgctgtagcctacgcttagctcccatccctggtttcttaccttgccggcattctggaagggagcacccataccaatgtggttggggatgtccagcttcatcaggataccatccgttatcttcctataccagtcggcagtgatgttgatacagccgaacagtgaaagatctatgcctaagtcagtcatggtagaagtctcccatgtaaggtccctattggagagcgaggtaacagcagaggtcgtgtaaagattacctcccatagatatagagcccgtagagagttgctgagtagtgggataataggaacttccgatattctggttgcccagtttgccccaagaggcacgtaatttcagattatccactctatcgcgtatagattccataaagggttcctcgctgatgcgccatgctgcagagaatgaagggaacacgccatatcggttaccctctgcaaatctggaagaaccgtcggtacggatattggcctccacaaggtagcgttccttgtagttgtaattcaagcggccaaagaaggagttgatggcccattggtactcccctcctccattgttcatgttctcaatgttaccggcatcaatttggtcatattgagggaagttgaatacttgacgataggcagaaagagtcttttctgtataggtctgacactccatacctgccattactttgaagtagtggtcatccagctgtttctcatagttggtcagtgcctgtgtgttccagtagaagtaacgataggccgattctgtaagcgagttgtaggtttcgccgctcttgaagctggtagtaccttccgggtcaccatacgtggtgacagaattcttatagttatggttattcttggtgatataacgtggagtggcttgaactgacacattccatccatcgagaatcttataggtcagagccatcgccatggtagcacggataacattgtttttcacaataccgccttcacgcaacaacagcacggggttattgcccatcagaccatttgccccattataaagaccagtagtaaattgattgacaatgttcggggttcgggtgttcatataattgaaggcatgtccttcgtagggagaactatttttattggcattgcttacttgtatgtcaaacttcatgtccagacggtcgctaagcttgatgtccatattgttgcgtacagagattttacggtaagaggaattgaccactatacccgtctggtccagataccctatagaagtaagtgtcttgatacgttctgatgaagaagtcagagtaagcgtatgcccatggttgaatccgttttctgtaagaatcaagtcctgccagtctgtattaggatagatgtccgggtcagtagccatgccagccacatattcccttatatattcatcactatagggcaggtcggatccgtcgttacctgctgccacattttccaattgcatatattccaatgcatccactttttgaggaagcatcgttgcgccttggaatccaaaatatcctttataggatatgctgaacttgtcttgactgccaccccgtttggtagtcaccagaatgacaccattggcagcacgtgagccatagatggatgcagatgcagcatctttcaagacggacactgactcgatgatgttaggatccacttcatctatggttccttctacgccatcgaccaacaccaacggggcggcactatcaccaccgaaggttccgataccacgtatacgtatatgaccgccattgccgcctggctcaccgctctgtgtagtgacagttacacctgcagccatgccttgcagagccgaagatacgtttgatactcgacggcttgcaagcttctcgctgttaagcgaagaaaccgagcctgacagattaaccttcttgttagtgctataacctaccactaccacgtcgttaagcaattgtgagtcttcatccagtaccacatgaatgaagttctcccctgcagtcttcagcttgagggtacggaagccgatgtaggatacgatgagttccgcgtcttcgatggtttcaaaattgaagttgccgtccacatcggtaatggttttctcgggagaatgggtcacttgaattgtagcaccgggaagtggattattgaaccggtccaccactttacctttgacgggtttcagtgaagctgcgactacattcaacgaaacaagcagcccacatacacacacaaaggatttaatcattcttgttttcattagtttctatgatgattttaatttcggctgcaaaagaatggatgctgtattacagacttgtgtcacttctgtgattttgatatgacaccggatgagagcccgacatatgtaacttgaacgtaaccccatagaaacgacgaagtaatttcactcacctatttttgctctcaattcaaacaacaaataattgaaagagaaaagcaatgaacaaaaagaacattttttacgccgcattgctgcttatggcaataggggcagaagctaaagagattaaaggcaaagtcatggccgacggcaaggggctggccaaagttgtagtaaccgatggcaccgcattcgctcttaccagtgaagacggaagctatatgattgatgctgatgagaaggcccactttatctatgtagtgacaccttcaggctatatggctccttgcaacgggggtactcccgtcttctataagactctgaacgagaacagccacgatttccagctccatcgctggggaacagtaggaggcaaatacgccatgatggcagcagccgatacacaaccgcgcggagagaacgcattccatcggcttgaaacggaagctttccccgacctcaagcaagtgggctttgaatatatgagccagaatattcctgctttcgccatcttcttgggcgacatcttatgggataacctggaaatgtttccccacatcaagcaagagatagcaaagatccaaattcccatctatccggttatcggcaaccacgaccacgacaaggaggtgagcgacgatgatgccagtgcacatctttatcggcatttctttggacccacttactatgcgttcaatgctggaaaagactattatatcgttttggacaatatcctttataaaggaaacaagaagtatgaagtggggctcaatgatcagcagctcaattgggtgaagagctatctgcagtacgtccccaaaggggctcatctgtttgtttgcatgcatgctccggcatacttctataacgagaactacaagttgggacgcgtagccgagttactcgaccttttcgagggttataaggtagatattctcagtggtcacactcatgtacaatgcaacacacaaatcagaaacaacattcgtgagtacaatatcgcctccatcggaggcgcgtggtggttatgggacggcatctatagcaaagacggtacccctattggctaccaagtattcgaatccggcaagaacggaattgcaaattatttcaagtcattaggacatgaccgtgactatcagttccgttactatcccgtgggtacagtacccggccatgaagacgaactctgcgtcaaggtatggaattgggataaccgctggaaagtggaatactacgaagacgggaagttgaaaggcgaaatgaagcagtataaaggcatggatcctgattatgatttcttcctgcagcgcaaagctgtcacagagggaaaggatatgaaggaacgtggtcgccaagctaacaagaatgcttatttctttttctctacaaaaccgagcgataaagcaaagaaaataaaaatcgtggtgactgacgccaacgggaaaagctacgagcagtctttggaacattaagtaaacagacagatagtaatcggtacctgattatgagccattccctgctcctcgttattcagctatcggttattattcgtacctttacccgaaaaaggaatgccacatgatacccaagcccctcattacctacatcgagacagcaatcatcccccgttacaaggagtttgacaaagcacacaacctctcacacgtccgcaccgtcatcgaagaaagccttgccctcgcccggcaatatcccgaagcggacgaacgcctggcatacgtcattgccgcctaccatgacacgggactgtgccgcgaccgcgccacccaccaccttgtctccggcgagatactgatggcggactctaccctgcggcaatggttctccgacacggaaatcctcctcatgaaagaagccgtagaagaccaccgcgcctctacagaccacgaacctcgtagcatctacggcaagattgttgccgaagcggaccgtatcatcgacccggacatcaccctgcgccgcaccgtgcagtacggattgaaacagaatcctgccgccgacaaggagtggcactaccagcggttccatcagcatctcatggcaaaatatgcacccggcggttatctgaagctctggtttcccgagggcaagaatgcggaacagctgaagaagctccaagccattatcgcagacgaaggacagctgcggcaagttttcaaccgaatattcgaggaggaaaagtaatagcggtatcaatgaagcatatgccccatttcatttccgactatggaaacggtttgtttcctataatggaacagagtgttctctataaggaaacaaagtgtttcctataacggaacaaatcgttttatcccgtcgaaacaagtcgtttcatacaagagaaacaatctgttccgacggggtgtaacaaagtgttcagtactgtgaactaatacaatagctctatttagaaggtctcacaagataagtatccgcctccataagtataaagacttatgggcgtgccaacatgaggaaatcataaaactcacagatggactggccttcggtttctgattcgaagacaaagaagagcggctgctttcccttatgcagctttgccggaatagagagcggagcatagaactctctgcaagtgctgccagccttcacatccacaagtcctatctctacaccgccttttgttgtccaagggctacccagcatgatgcggatgcgtccgtcggtatcttcagccttcaaccttaactgcatctgcaaagacttatctcgcggaacggcattcatattcaagtatttatatcctacaatcgacccacttgtattattcaccaccggagcgaacgggattttgtggttgttatcgccggcatagggattattatcccggtacacaggccggatgtaagaccccgtgtagacataatggggatagacctctttgatacctccgggattggtgtgccaacaagccaacccggccgagatgcgctgcataggattgagcccttcaagaaggaaaccctcagagttgaattccccgcgcgaaatcacgactttcccaccttttcctttttccacctttacatcaatggccgacaccatagcctggcgtgcatagcaatcagtacctatctggcgatgatagaacacgtaccattgccctcctatcttgcagatactgccatgcgtatttccaccgggcatggccgaagctatcacattgcctttttcatcatactcgcgcgcacgggcatcgatgattgttccgccataggtccagggacccagaggatgctcgctataagcgtatgccagcgtatagttgctggcgttcggcaagccatcttcaccctcagcggtagtacggctatagataaacacatacttatcctcaatcttgcggatggaggatgcctcaaagaagcggaatataccttcctgccgatagcctgaaatcatgttctccaccacttcggtacccggctttaccgtgcacatggtagcagggtccaactccgcgccatgcgaaatgccaaatccccaataaccatacacacgtccatcatcatcgacaaacactgcggggtcgaatcccaaacaaccgaaagtctcgcgaggacgttccttgttccaattgcatactgtaaacggaccatcgggacggtcgcttttggcaatcatggaattgcgtccactaccttgattattcggaaagaggtaataagttttcttaccatcggtatcggtagttactgtcacgtcaggggcaaaaagcacgtcgtcggttccatcagcattcagtttatacagctcgggcgactcattgactttaaatatcacgccgtcatatctccaacgggtcaggtcctctatgggtgccgaccacaccacttggtcacgtccgcaatacatccacttgagattgtcgtgcgaaccataaatatagacacggtacttgccgggacagtcaggatcctcaaacacatagggctcaccatcaggaataaattcccaaagcggcagataaggattctgtgcagataatgtaaaagacaagctgatgagacatgataaaatcatcagaatttttcttactttgtttttcataatcgcattgatttatagaatgatacttaaattataattgcgacaaaactatcaatttatcgtttcatcgtcatgcttttaatgcaaattaacacgttcaatacgaatttctaaataccgttccggcggctctcccatctcctcctttcttcgttggtgtatgcaaaaatcagctatttttcagtaagtttgtccggtttgcactatctttgcttaaaaaagcgaagataggctgcacctcagcataaaaaatgaacgagttcattttattctgcattcggtttgcactatctttgcatccaattaactgaacaataactaaaaaaacaagataacactatggcattaaaagctggtatcgtgggccttcccaacgtaggaaaatccactcttttcaactgcttgagcagcgcaaaggcacaagcggcaaacttcccgttctgtacaatcgacgcccaaatggggcaagtgtccgtacccgacgaacgactgacgaagctcgccgagctggttcacccggggcgtatcgtacctgccgtgtgcgacatcgtcgacattgccggactggtgaagggcgccagcaaaggtgaaggactcggcaaccagttcttgggcaacatccgcgagtgcgacgccatcattcacgtgctgcgctgcttcgacaacggcaacatcgtccacgtggacggttcggtgaaccccgtacgcgacaaggaaatcatcgacacagagctgcaactgaaggacctcgacacggtggaaaaccgcatcaagcgtgtagagaagattgccaaagtgggtggcgacaaggcggcaaagatagagtacgaactcctgctccgctacaaggatgccctggaacaaggacaaagcgcccgcaccgtcatcccgcagaacgacgacgaggaacaatgcgccaagcagatgttcctgcttactaccaaacctgtgctctacgtctgcaacgtggatgacgtcagtgccgccggcggcaaccagtacgtagagcaggtgcgcgaagccatcaagggcgaggatgccgaacttatcatcatctccgcccagaccgaggccgatattgccgaactggagacatacgaggaaaaacagatgttcctcgaagacctgggactgaaagagagcggttgcaaccgtttgattaaagctatctacagcctgctgaacctcgaaaccttcatcactgccggagagatggaagtaaaggcatggacctatcgcaagggatggaaagcaccgcaatgcgccggcgttatccatacggatttcgagaaagggtttatccgggcagaggtcatcaagtatgaggattatatcaagtatggcagcgaagcagccgtgcgcgaagccggaaagttgggtgtggaaggcaaggagtatgtggtgcaggatggggacatcatgcacttcaggttcaatgtgtaatgatattcattccagatggcaatgtacaaagaaagtacattgccattttctaataaactccatacaataacaatactgtgaaacagattatcttccttttattcttattgtcctgtactgccgtttatgcacaacagcaagactcggtaaccattcacggacgggtgactgattacaacggacagccgatagacagtgccagcgtctggtggcaaaacccgcagttcaatgacatcatagaagccataaccgacaaagacgggcattacacggcccgtatacccaaagggaaatatcaaagtgcagcctctatttatctgccctcctatgcgcacattgccatgaaaagcgggctgcccgagactgaacaccgcctggagttctgggcctgggatttcatcgccgaccgcgacactacactcgacatacgttatcatcgtatggaagcttatggcctgcgtgctttctgcatccccggagccatgcctacttatcagatatacgtccgtcccatgagcttgacacgtacctaccaatggatgaaagaaacaaagcccgagtcattggtacacggtgaaaacctgagtgacattgagcaacaagaacaaaacaaagaagccagagaatgccagatggctccccgccccgggcaactgaaagtcaccgtctggatagacggcgagaaagtccccgtgctgatgaagcaggaaataaaagaatatttcgacagcaacgaatatggcaacgcctatctattgacagtagacatgcccaagcatcccaaaaaagaccttccctaccgtatcttcaaagtagagctggaagacatggaaaacggtgaccggggcgaagggctttactatatggaaaaggaaaactacgttcaataaaccatacacaacaaatggcaaacagtaatctgaaatacctcatagcaggtaccggcggcgtaggcggaagcatcgccgcctttctttcattatccggcaaagacgtcacttgcattgcacgtggcgaacaccttgccgccatacgcgggaacggtctgcaactgcactccgatttgaaaggtgaacattgtctgaaagtggcggcatttaccgcagaagaattccaaggcaaagcggatgttatcttcgtctgcgtcaaaggttattccgtagactccattacggaactcatcaaacgtgcctcacacgagcgtacagtggtaatccccatcctgaatgtttacggaaccggtccccgtatccagcggttggtccccggcgtcacggtgctcgacggctgcatctacatcgtaggattcgtatccggacggggagaaatcacgcagatgggaaagattttccggctcgtctacggagcacaccgcagcacgattgtttcccgtgaaacattggaagccgtgcaacgcgatttgcaggaaagcggcatcaaagccgaaatctccgacgacatcaaccgggacacattcgtcaagtggtccttcatttctgctatggccgtcaccggagcctattacgacgtacctatgggcgaagtccagaaaccgggcaaagtgcgcgacacctttatcggactgtcacaagagagtgcagctttgggcaggaagttgggtatagaattcaaggaagacatcgtgcagtataacctcaaagtaatagacaaactcgcccctgaaagtaccgcctccatgcagaaagatatggccaaaggacatcagagcgaagtacaaggcttgttgttcgacatgattacggctgcagaggaacaagggattgaggtgccgacgtataggatggtggcggagaaattcaaataaactgccacgatgaactgccaaacgagataatttcatacctttgtcccgaacaaccccgtaattcagtaatttaattcttcataaatatgttatcactactcaccatcaactggaaccccgaccccgaactattcaacttcttcggcatatccatccgctactacggtttattatggattatcggcctcgcctttgcctaccttatcgtgcaacaccagtaccacgaccgcaaaatagacgaaaagaaattcgaacctcttttcttctattgcttcttcggcatactgataggcgcacgactgggccactgcatattttacgactgggcctactaccaggaccacttcgttgaaatgattctccccatcaagcagaccgccgcaggatggaaaatgacgggttacaccggccttgccagccacggcggcacgctgggcctgattatcgccctctggatgtactgccgcaagacgaagatgcactacatggacgtgctcgacatgatagccgttgccactcccatcaccgcctgctgcatccgccttgccaacctgatgaactccgaaatcatcggtaaaccgaccgacgtgccctgggcattcatcttcgagcgcgaagacatgctgcctcgccatccggcacagctctacgaagccatcgcctacttcatcttcttcctggggatggtctggctatacaaacgcggacagaagaaacaagagaccaagctcgaaacagatttcagcaccaccaagcggaaatcaaccaccgtgcaggccgaagcctccctgccctatcaccgcggtttcttcttcggactctgcctgacggagattttcaccttccgtttcttcatcgagttcctgaaagaaaaccaggtgaactttgaggacagcatgacgctgaacatgggccagtggctcagtatcccgtttgtgattatcggggtatatttcatgtgtttctacgggaagaaagcttccaaataaacatttcagccctacataagcaacatacccacccctttcatctgtgtggatttctctacttttacggcatcgaaacagtaaccgtaaatcatatatttatcatgaaagagagacaactgatgaaaggggcagcttttatgctgctggcagcaactgccaccctgcctgcgcatgcccaactgaaaacaaatgccggcgtgcaatacctgctttcccagtcgaaagacatgagccaggattttctggacctcagcaacacctatttcttcgccgacagtctggtatcgttcgacacctccaccggtaaaggaaccgtccagtggaaacgccagcaactgatgccccgccaggcattcaatgcaaacacttacctgcaccagcccctccagtcgctggacttcccggagacggcctacgacaacaatccacaactgacgttcaccgtcgaaccggtcagcgaacgtaccctccgcatccatatgcttacctcgcccatcgtaccgaaagaagatgccgatgaccccatgctcataggaaagcctgccgacggacgctccttctggaaagccgagaagacggataaaggtaccctgtacacctcccgatacggcagcctgctcatccagaactatccctggcgtctggtactgaaagacgccgacggacgcctgctgacacagacccgttgctggagcgacaacgactctacgcaggtcaaggtacctccattcagcttcatcaagcgcggctcggacaactcacgcagcatcaattccgtattcagcctcgcgccgaacgagaaaatctacggttgcggcgagtccgccaccgcactgaacaaggccgggcagaaggtcaacctctttgtcaccgacccgcagggccccgaaaccccggacatgtacaagcccatccccttcttcttcagcaaccgtggctacggcatgttcatgcacacttccgcccccgtgacctgcgacttcggctgttcctacatcggagccaccaaactcttcatggcagacgaagcgatggacatcttcatcttcctaggttcgccgaaggagatgctgagcgaatacaccgcactggtaggacggcccgaaatgccccccttgtggagcttcggcacctggatgagccgcatcacctacttcagcgaagcagagggccgcgacgtagcccggaaactgcgtgagaacaagataccgagcgatgtcatccacttcgataccggttggttcggcgtggactggcaatgcgactacgcctttgccgccgaccgcttcgacaatccccggcagatgctcaccgacctgaggtcacaaggtttccgcacctgcctctggcaacttccctacttcactccgaaaaacaagttcttccctgagttggtagaacgcggtctgtacgtgcgcaacggcaagggacagctcccctacgaggacgtggtgctggacttcaccaaccccgaaaccgtgcagtggtatcaagagaagctcggcaacctgattgaaatgggtgtaggcgccatcaaagtagacttcggtgaaggtgctccgctggatgccatctatgccaacggccgtagcggactatacgaacacaacctctatcccctgcgctacaacaagaccgtggccgaggtaatcaagaagatacacggcgaaaacattatctgggcacgttccgcatgggcaggctcacaacgctacccgctgcactggggcggtgacgccgccactaccgaaaccggtttcgagggaaccatccgcagcggcctctccatcggactgagcggattctgcttctggagcaatgacataggcggcttcgtgacccaaagccccgaaagcctctaccgccgctggctgcccttcggcttcctcaccagccacagccgcgtgcacggagcacctcccaccgagccgtggtactacgggaaagagttcacagactatttccgccgttgtgccgaactgaagtacaaactgatgccctacgtatatgcacaatccaaagagtgcaccgaaaacggctggccgatgctccgcgccctgctgctggagtatcccgacgacccgggtgcatggctggtagaggacgagtacatgttcggctccaatctcctcgtggcccccatgctcgaagagggcagcggacgggatgtctacctccccggacggcagaaatggatagactaccagaccggaaaggtgtatgctccgggatggaaccatatcgagtgcggcaccctgcccatcatcattcttgtaaaggacggttcggccatcccccatatccccgtggcacaatgcacagaccagatgaagtgggacaagattacgtggaagaagtatctggcagacgaaaagaaagccgaagggttgctctgcctgccgcaggacggacggttgcaacgaatgtccatcccataatcccctatcctttcatgtacgagatgcgcatctcaagttgcatgaaatatacatctcgtacatcatgagatgcacatctcgtgcagacaaaaggtatagattgagataacaaccaagaatgtttgctatgacaacccactacattgaatccattaaaccctaatgaaccatgagaaacaagtcactactcctcattttctctctgctgctttgcctgcagacaagcgcacaacaaacacaagccttccaagataccacgctcaccgacgaacagcgcgtggaccatcttctttccatcctgacattggatgaaaagataaaccttctttccaccgacctcggtgtcccccgcctcaacattccccgttgcggacactacgaaggactgcacgggctgaccctcggcgggcctgccatgtggggcggacgccaaagaacggaagacgggaaagtagtccccacagactgccccaccaccatattcccccaatcctacggtctgggctccacatgggacaccgatttggtgcagaaagtagcggaacaagccgctgaagaagcccgctactacatgcagaccaccggcaacaagcgtcatgccctcgtgatgcgcgctccgaatgccgaccttgcccgcgacccacgctggggacgtaccgaggagagtttcggagaagatgctttcctcaccgcccaactcaccattgccagcgtacgcggcctgcaaggcaatcatccccgctactggaaaactgcctctctgatgaaacacttccttgccaacagtaacgaggacggacgggacagcacttcctccgacttcgacacgcggctgttccatgaatactacgcttatcctttctataaaggcatcaccgagggaggcagccgcgccttcatggccgcctacaacagttggaacggcatccccatgtccatccatccctgcctcgaagagattacccgcaagcaatggggcaacaacggtatcatctgtacggacggcggtgccctgaaactgctgattgaagcgcacaagagttttccgagctttgcggagggtgccgctgccgtagtaaaagccaccacaggacaatttctcgacgcatacgttccttacgtcaaggaagctctggaaaagggattactgaccgaagtcgacatcgacaaggctatccgcgggaacatcttcgtcgccctcaagctcggcttgctggacggggaccactcccgtaacccttatctctccatcggaaaggacagtacggagacaccgcctttcatgacagcagaagcccgtaggctggcacgggaagtcaccgccaagtctgtggtgttattgaaaaacaagaatctcctgccactcgatgccggaaagctgcgtaaaatagccgttataggcccgtattcggacaaaatcgtgcaagactggtatagtggtaccccgccttacgaaacaacgattctgagcggcatacgcaatgctgtgaaagaaggaaccgaagtcatccacgccgaagacaaccgcatggaccaggcggaaaaggctgccgcagccgccgacatcgccattgtatgtgtaggaaaccatccttacggcacacgtgcggactggaagttctctcccgtccccagtgacggccgcgaagccgtggaccgcaaatcgctgatgctgcccgatgaagacttggtgaagctggtgctcaaagccaatcccaataccatactggtgctcgtcagcagtttcccctacaccatcaactggagccaggagcacgtgcctgccatcgtccacatcacccactgcagccaggagcagggcaacggactggccgacgtactctttggcaaggtgaatccagccggacgtaccgtacagacgtgggtgaaagacatcaccgacctgcccgacatgatggactacgacatccgcaacggacgtacgtatatgtaccaccagggccctgtgctctatcctttcggctatggtctgagctattccgactttacgtacgagaagattgaatccgtcaagcaagacaagaagaacatccgcgtgacggtatcagtgaagaataccagcggacgcgacggagaagaagtcgtacagctctatgccagctatccggactccaaagtggaacgtccttccaagcagttgcgcgccttcaagcgtatccccatcaaggccggcgaaacccggaaagtgacgcttaccgtgcccaaagaggagctcggctattggaacgaaggaaagcagatgttcgttgtagaacccggaacggtgaagctgctgataggggcttcgtcggaagatatacggttggagggaaagatcaggctataagaatgaaaaagccatcccttaacataccgactataaaaattagcgagttatgccacaacaacgtggcaaacccgctaattacatatttgcaagcataaatgaagtacaaggtcactttacaataaactcatatcttcctgccgccagttccaccacccgtacattctcggccttgtcaggtaaagtgagtgtagctgtactgttagcgggcactgtaacttcataatgcacacatttccctttccattcccagcgagaaacaatttcaccgtaaggcgaccgatgacgagcttcaaaccgtttcaatccctttatgaaatggggacggagcagaatgttttgaaaaccaggttgcgcgggatcagggaaaatacctcccagccccttgtagaaccaagcacctatttcaccgaacatcatatgattgtccgagatgtcacgagtagcctgcaaatcccagttctcgagcagcgtagtggcaccgttcaccatccaccaaccccatgaaggataagtgtcctgtacagccaccttataagctgtttcagcataaccattttcgctgagtgcattcagaatagctttagctcctaatacacccacatccaagtgaaaaccgtcctcctctaccttatgtgccaagttagctgccacttttcctatcaactcttcgggcacaatcttccattgcaagggaacactcaattcggtttgtgaaccttcggcatagatgcctgtttctcgattcaggaacttatcattgacagcttgctttatctcctccgacaaggcattataatattcgtaatcggcctgtttgccgaagagtttggcagcagcggccaaaatcttggtatctacataaaagtagaccgaggaagtcagctctttattggattttgacttcaccggcacccagtctccgcgcccccacgtagtgagatgattgttagagatacgctccacataatccacataacgtttgatgctctcgtaacaatcgctcaagggcttgctatcaccgtagaagaggtagatattccaagggatgatggcaatagtactagtccagtccagcccgttgtctgtaccatatccccatccaccagttggaataatatcgggcagcactccgttgggctgctgttcgtcacgatggtcggccaaccatttttcgtaaacggtaattccatcaaagttataaaatgctgcctcaatggcaaaatgaccgtcaccagtccaaccgttcttctcgcgctgagggcaatcggtggggtagcccatcagattggaaaggtaagagtgattggcagcatggagcagcttgcctatcagtggactcgaagattccaagctacctactgccggcacatcactgtgcatgaagtaagcaatcaagctgttttggtcaagctcaataggcttatctgccattacctccacataacgaaatcccttgtaattaaatcggggcatgaactcatcctcttctccactcagaatgagaatgtccgtctgaaaagggtctttctccttatcgcctcgaaagtagacatcaatgttcgagagatcgaggcggccatttggatgtaagcgttcgccatgtttgattctgacctccgttccccgttcacccgaaacatgaatacaagtcacaccggacatattttgcccgaaatcatagatgtatgttttctcgtccactttgcggaaagagacggcggggaaaatctttacattacggatgggatgtacttgctgggcagtgacattggaagaaggtacactccgataggctactccgcgccacttggaatcatcgaattccggagtgctccatcctttctgctccagacgtgcatcgtagtgctcgccagtatagatactattaaaagtgattgcacccgacgctgtccgccaactgagatcggtgggaatagtctccacgcttccatcggtgtaagtaatgcgcaagtccagacagaaagtgggacggttgcgccaaggggcacggtcgaagtcccacactgctttggattgatggttataccaaccgttacccaaaagtacgccaatagcgttgtcaccattctgtaattgtgaagtcacatcataagccacatacaagttgcggcgatcaaagcgggtatagagaggggcaaggcagtggtctcctatcttctcgccattgatgtaaagctcatatagtccagcagcggcaatataagcacgcgctgactttacctttttgccggtcttgaactcttttcggaagtaaggggcaggcccataatgaatatccttgccatcgccaatccaagcaccttgccaatgttgcatccccatcatgcccgtttcaaagtaagagacaggagaagcagtctccttatattccatgtcgctgcagattactttccaataatatctagtgaaaggctgcagttttttgcccgcataggccacaagctgattacgggaatcgttctttccactatcccacatcctgccacagccattgaccacattcaacgagtcttcgtctaccacaatccgccaggaagtctgcacagctccctgcctaccatcttccatccgccaagaaaggcgtggaacgggattatccaaacctataggtctgtcaagatgttcgctcctcagatcaaccaaacgaaccggagtctgcccttgtacagtaatgcaagcaaagaatgtgaatagaagcagtatatttcttttcataactccattgtttatctattccgtagtaatcaccagttccttgccctccctcagttggtcatgggtgataaagtaaccgtcaatctttttaccgtcataagtaatgtcaataatcttcttgccgcttcctttcttcacaatcgtaaagggacgaccattcagattgaacgtcactttatcgaacaagggaacagtaacaatatattcaggatcggcaggcgaataagtgtaaagtccaatagcattgagcacataccacgaagacatctcgccggcatcatccatccctgcataagccagcttgtcggcacccatgtcatagtagtggttcatcagactgtcaagaatgcattgggctttctcttgtttgtctatgaaataataggtgtaaggaatgctgtgtcccggctggtttccgtggcaatagtttccgatgaatccggtcaggttgtgggcctcgtaacctctccacggttcgctgaataaggaatccagtttagcctccaccgcctctttactgggatagagcttaatcatgccttcggggtcgtggggggcgaagaagagggcgttccatgcattggcctcacggtacatgtactggtaatagggataatacggatcgaaatcctgaatccagctaccatcgtcaatcttacctctccaaaagccggtagaggggtcgaatagcgtcttgtagttgttggagcgttccatcatcagtttgtagttggcttcatctcccagctccttggctaccaaggctacggcatagtcatcgtaagcatattcctgggtcttggtcacagcccctttgtattcgtcccatgtgggtacattcactgtgtctttttcagcaatccaacctcgctccatatactcatccaaatagcgacgtcctcctttaccgggcaccgtagcatttttcagaatcaacttataagcacgctccagatcgaaatcatgcaaaccacgcaaccaagaaccagaaataaaagtggaagcgtgatcaccatggaagaaggtgggcatgtagccgtcacgcttctcacctttgtcaataatagacctaatgatgtcagtagtcacatcgggagaaatcatacctatgagtaccagtttgttgcgataatcgtcccaaaaagaagggtcagtgtaatagtggaagccgttattcactacttcgccacggacatcagtatattcatgattcacatcgctacgcaaagccggccatttaaaagcatggaagaaagtagaataaaacaatctcttttcacgttccgtgccacctgcaacttgaatcttggagaggagtgcttcccaagccgcatcagcttcttctgccacttgtgcaaaacttttgttcaacatttcggccttcaaattcatttgagcattctctatactcacaaacgagaaaccagccttcacttccaaaggttcaacacctttgctgtcgataaaacgcagcacagccacctcatgtttgtcgtcttttaccatttccacttggcctattttatagttggtcttagcgtaaaagtagattttaccatcgccatcttgataacccgtgaacgtattatcgtcaaccttctcaatcttccaatcacggacatcattattagaacggcggatgtctaccaataatgacttatcgtcgcccttgccgaaagtatatttatggtaggcacaacgcaaggtactggtcaactcggcgttcactttatagcgttccagataaacttggtaataccccggatgcgcagattccttctcgtgactaaacccggagcaataattacccggagcgatagttcccaccactggcaacatggggacatgcaacaagttccaatgccctttagcagtatgtgaaaaaccataaatcacagtgtcctcatattgatagcccgcaccgctacgaaactgtgtaacggggctgagctgcaccattgcgttgggcaaggtagcacccggataagtttccgcaccccatgtacgtgactttattttgcgcgtataccctaagtcctcaggctcccacaaagtagccgtacccaagaaaggattgacatattcggttaatttcttctgcgtaccgccacagcccgtcagaacaatcagggcgaacagtagaaataaatattgattctgtttcatcttttgtgtttattttatataaaaaactgttgtctctaaaaacattatttccaaaataactgccaattaaaactggctctaaaaaaaaatgtgccgaaacccaataaccagattgagtttcgacacacttttaattgctaacttatttcaggctcttttcaaagagagctttggcttcaatcaaagtacaaccacttgtctgcgtagtcagatggttgttgccgctattgttcattgcccagttagtattatacagcaaatcaagtttattgattccctttcgccacaagatttcagcattattgttaaagaaagtgatgaatttcttcttatatatggggtccaaattcggttccataatcaactgcacataataacgcatgaaaatacccttaaacaaacctccgtcaccatcgccttcatcacgaagtaaattgtttccagtatctatcatgctgctattactgataccgaaattggcagccttacgagcatctttcaaataggactcttctcctgtgatcttatacagttcgtaagcagcacccaagaatgtaccttggttataagaaagagaaagtgtactcaactcacccgtttcaccgttcacattatcatagatggcgccggtagcagggttaaataaattttcacgctcccatttataaatattgacagcccaatccaaatcctcctgattcccgttaatacggtaaagacgagcagcaatcaaagcagcaggaccgttggaacaagcatttttgctccatagccggtcgtgagtccaagcaatgccaccacctgcgtaatcgttccaaccggtcttgatttcattccacatctcttgagaagtttccagatacttgttttcatcagtaacttcgtacaagcgaatcatggtgagagcaatccactccatatcatcataaaagttgttccaataactgccaccgttctttgccttgataccgacataccatttgtcgaacaagtcgctgtacttgctatctccggtacgattgtaagcatctatcatcacatccatagcatgagcctgcggccaataatggaaatccttgattgaaccgtcattcccgtagttgaaataattctcttccgtattccagaaacgatctatcagggtcacagaactgctgtcggcagccgcatcccaatctatggtgtaaagccccttatcatacatatactcatcttctatctcgcacgattgaagtgccaaaagaagcaggggcagacaaaataatatttttttcataatctctccttaaattagttggccaattccactttatgagtatagttctccacattgaatatcacactaatcttggtgatggcacccggattgtggccatcggccgcaccatcgaattcattgttcagtttccacttctgatcccattggttatcaggagtctccataatgtagaaataaggatcttcgggagtagccgcaccaggattagagtctgtagtattcttggttccccaatactgtatactaccatcagcataagtcatcaagaacttatagcgttggtcgcgcccccatccttcttgcttgaactcaattttatcctgaccgcagaacacaccgtttccaacataaggcaattcaaaagttgcggcaccactcggacagaagtagaattccatcttacttacttccctgacggttacagatgcaatggagaaatccatctcaatgcggtaaactcccgtcttttctacggttgtctcgccttcgccttccataatcttattgccattgatataaaacaccttggcaccttcggctgctctatctaccagtttgtaagtctttccgccttccaacttcgtaaagacttcgaacttatccttttcgggtgaagcacacgccacagccttagaagcatccataccaccttcagtagcacttccggtcaagtaaagctgtgccggaatctcttcaaatcccaccaagcgagtgatggtgagcttcttgctttcctttgccattacagaattcaaacctctggaagccattactgtccaaacaagtgtacccgtctcaccactgttcaatccggcagccgcaccaaccttgttcaatgtcttgtggctgatggtagcatagctcaaagaaccgccattgtcagaaagcactttgtaaataggcttagaaaaatctccaccttctttatcgaataccacttcataaagaggggcaccgctatcttcagccttggccgactcccattcaaagaacaggctggcgctggccgacgattgcaagactacttccttgccgtcagtgggttcatacaactgatttactgaggaaactttggaatccttgtattccatgtcttccgtacaagacgtagcaaagaggactgccgaaaaaagagctattgttgagaatattgttttcattgttctattgtttttaatgagtttagatacacgttaatttccatatcccggattgttaggcgccagattgggattcaaattgatttcactgataggaactgcccaaagataatctcttgcctcttcgaacttgcgagtgtcaagcttgttctcgtccacgaagcttgcaccgcgcaccttgcccgacaagtattcgttaccagccttccaacgcttaatatcataccagcgcaaaccttccatcgccatttctacacgacgttcgtcgcgaataatctgcctcatctcttccttgctctttccggcaggaaagttcaaggctgcatcggcagtaaatccggcacgttcgcggatgggacggatggtcttgttccatacctcttcagtcataccgcttgtttcgtgaacagcctcagcatacatcagcaagatgtcagcatagcgcatagtgatgatattcataccggaattctggtcaccgggagcctgcggattataacacttacgggtgaaataaccggtagaagtgccgtttccaccaccatcgtaggcatcggttcccgaacccggacgaatgttgatgactacgtctttactgccatcgtccacattgccactccagtcatagccatcataaatgatagtagcggtgagacgtgggtcacggttgtcgtaaggataagcagggttataatctgtcccggcttcactgatagtctttccactaagcatcagataagtgtctaccaacgattgctgcggcacacggttcacggcacgtccgcctcttgacaaaggaatcatgtctaccatctcaccccaagtaatcaaattgggtacataagaacggtccatgataatctcttcattatactcattggcttcatcaaaaagcccggcataatcaggaaataaggcataagtaccatattcgccctgtttgttcatcagattgtcgcaataaagcatcacattgttccagtcgctatccatcaagtagacacgagcctgcaaagcacaaacggcacctttagtaattttgcccttgtcttcttcgggcaattggtcgcgagtgggaagcgcatccttgatgtcttccaattcttggtgaatgaagctgataatggtttcgcggtctgtacgacttacactccgcgattcttccagcgtgatgtcctccgtaaagaaaggtactgcaccataaaggttagtcagacggaagtagaggcttgcacggatatagcgtatctcggcaatcatacgtgctttaacagatgcgtccatgttgggtaccagatccaccttttcaaggaacacgtggcaggtctttatgcctccgtaaaggtctttccattcattcttgaagatgtcgagcgagggagtagccatacctttgcgaatggcacgttggtcgtccacactgcgaccgtcgtaagcattgtcactcaaactttcatcgctccacatacggcctgcattgtacatctggctgtaagccatgttcaccacatactgggctttggtggtggaagtccaataagagttatccgtaaatttgtttgtcggtgcgttctccatctcgttgcaactgcaaagcatcagaacagccattccggcaaaagctatatattttcttagtctcatagttatctgttgtttttagaattcaatgtctataccgaaaccatagtaacggagcgtcgggtagtttctaccagaattggcgccactattacccatcttagagtcgaactcagaagattcagggtcaataaacgagttattactgaaagtcagcaagttttgtccgttgacatagatacgtgccttttccatacccaccttgcggctccatgttttagggaatgtgtaaccaatctgcaagttcttcagacgcaggtattttccatccatcaagaataggtcggaaccttgtccgtttccgtagttgtttctgttggaagtagaacccggagcagtaagtctcggccaacgtgcatcggtgttggtaggagtccagaaatccagttgatgcttatagatattataagagtaattggcgtggaacggttcaatcaattcaccacgaagcatcatgtcacgcttgcccacaccctgccagaacataccgaaatcgaatcctttccattctacattgtagttgaaaccgaaagtaagacgagggaaggcattacccaagataaacttatccttcgagtcgatgacaccatcttcgttacggtctacaaacttcacgtcacccggctgtacctttccacctacaggaatagccgatgcctcaatctcctcgtagctttggaaaaagccgtccatcttgtaaccgtagtaagactccaacggacatccttcacgggtgatacggctcaactcctctatttgtgagattctttcgtgaccagggtacttcagcacttcattccaagagtcaccaagattgaagttgaagttatgatttgcggctcccgttttcaaacgatagttgatagagaggtcccaaccttgattctgcatctcaccaatgttgtccatcgccatatccgtaccgaataccgaaggcacaaggggcttcattaaaatgtcgctcgtacgcttgtagaaatagtcgaacgtcacattcaaagcgttattgaagaacgaagcgtctacacccacgttgaaggttttggtcttttcccaagtcaaattatccttacctaacttaaaacctgcgcctgatactgtctggttattatatgcgtaagagttgttgtacagttcgtaaacagtaaaacggtcataagtaccaatagactggttacccaagataccaaaagaagtacgcagtttcaagtcacccacacgttccttgtaagcctgcataaagttctcctcgctcaaacgccagcctaatgaaacagaggggaagaaaccccatcggtagtctttatgaaacttggaagaagcgtcataacggaagctgaattctgtataatatctgtcagcgtaagaataccccacacgtcccaacagagaagtcagactggtacggttggattcatctacaaatgtttttcctgtgatgtttcccacagtactattggtaatgtctgtaccgatacccaagtcgggatctacccccttcttctcaatctcattgctagacgaagtaaacgattcattggttactccaaaaagcccgctgacattgtgtttaccgaatgtcttgttgtaatccaacaaaagttggctattaataaggtaagccgtatgattccagttactggtccgatagtcagtatctttcactggacgtggttcggtagcctcttcattcaagtaataggatacgcccaaattgcgggtagaacgcatgtcgtttatcacatccgcacccaacactccacgcaacttcaatccgtcaataagccggaattcagcattgacattagcgttcagataattgttacgatacttgttacggccaccagcttccaatgctcccaatgggttaaattcagtcaatacatcatttaacaaatatcttccatcttccgatttcattttgtaataataataagtaggtacacgggcggcatccacttccaaactcccaccggtggtacttacactattattacgtgtataagccaaaatagcattcagtttcaaacgtcccacttccgtgctaacattggtacgaaaattataacgctgcacgccaaaatcactgttgcccacataattactttcctggtcataataacccatggacaccatgtaagtagttttatcactacctccagatacgcttagattgtaattctgctgtaaggctgtgcggactatctgatcaaaaaaccagctttcttcattttgatgggcagccaggtcacggatttgatcgggtgtatacaaaggagcctctccagcattggtggcagctaaattgcgcaaagtagcgttctgatagcctttcaccggagaaaacaagatatccggattctgccatcccatcataccacttaaccgaactgtcgcacgctggttcttcttacctttcttagtagtaaccaaaactacaccattggaagaacgtgaaccataaatagcagctgtaccggcatctttcaagatggaaatgttctcaatatcattgggattcaatttatcgaaactaccgccatcagctaccaatccgtctatgacaaaaagcggactattgtcattcacagtgctgataccacggatattaaagttagtcttacgatcattaggattgctactgcgctgctggataaccacgttgggcgcagccccttgcaaagcatctgtcatgttagccacgggacggtcttcgatcatggaagcctttacctggtctacagcacctacggcactcttgcgggtagtagtaccataaccgatgacaataacttcatccagcaccttggtatcctcctttaagacaacattcaattgtttttgatttttcacagcaatttcctgagtggcatatcccacataggaaaagacgagaacatcttgggcactacaaacaatggaatagtttccatccacatctgtaatggtacccacaccttctttacccttaacagtaacactcactccaatcaggctttcacctgtggcatccttaacggaacctctcaccgtggcattgttttgctgcaccacagtaatagtctccgcatgtgcataaaccgcaggagcctgcgccagcatagtcacagcaggcaaggcaataagccagaacttatagttcccacttatccgagccagcaatgaatttactgtgtacactcgattctttttcatattctttaagattaaacattataataaatcacgataaaaaaaggaaaagaacacaaataataccaacgaacaaccaattcatgcaatttgtatcctaatcctccttccagcgcactttattgattttaaataattcctatttttacaagctgttcagcaaatccactttaccctcgttcactaatttcagaatcaattctccaaacagcgtgttctgccaagcaaaccatgcacgggtaaagttagtggggtcatccttgtggaaagactcgtgcatgaatcccgtaccggcatccgtatccatcagcattttgatacaaatctttatctcctcatcattctggctggtgaatgccttcatcatgatactcataggccataccatatcataaccaatgtgcggacctccgataccttcaccggctttacctttaaaaaagtaagggttgctgccactccacacaaagcggcgtgtattctgatagataggatcgtttacgtccacatcacccaaataaggcatagcaagaaggctgggtacattggcatcgtccattaacagatgattgccgaatccatctacttcaaatgcatagattgtcccaaactcaggatgattgtaagtggcatatttcttcagggctgcctccacttcggctgccaaatcggtgcattctttggccaaggatgtttccttgtttacttccgtcagaatttcagcagcctttctcaaagaagagacagcgaaaaagttggaagggaccaggtactgaagcgtagtggcatcgtccgatgggcggaaagcggaaacaatcagtcccaccggtttgaccggagcacccaagccgtcgttattcagcgtatcaagagcacgttccgtcttacgttggaaacggtaagggcctacaccgtccttacgctgctgttccttgaaagtcttcaggatagcagtaattgccttcatccattcaccgtcgaagatactgctgtcaccagttactttccaatattggtaagccagacgaagcgggtaacaaagagagtctatctcccatttgcgctcgtgcagttcgggcttcatatctgtcaagtcagtcatccagttgccacccgtaggtccgtcgttgaaagcattggcgtacggatcaatgttgatgcaaaggaactgacggcgaatgacaccttcgagcatctctttcaattgcgcatcattgttagctaactgcacatatggccacacctgcgcaccggagtcacgcagccacatagcatggatgtcaccggtataaacaaaagtatcgggtttaccgtccagcatgcgaaagtgtacagtagtgtcaagcgtattaggaaagcaattctcaaacatccacgccaacttaggattggtaagcagtttcttcacgcgaagaatctcagcttccaccgcttttgaggtgaaaaggcgtttcttcatttttggacgattgctcttgtaagcagcagtcatctgagcatagttctccacacaagtgttgtcacctttcagggtaaaagtgtctgccttagcatagccttgcatacagagcatggcaacagcgcacaaggtaatgtttctctttttcatttggtctgattcgttttaattataaagactgattagcgaacacggccaaacgcgcgtacatctctaccatggcggcttgtgtcagcagccatttacgattgtcgcagctcttgccggtgaaatcagtattgaaaaggccgttatcttcacgggcatgcgtccaagcatagtccagactgcgggcaaaggaatcaagataaaccttgttaccgtccacctgatagagctctataaaaccacgcaacataacggcggtgaaccacacatcgcccttcttcagcatacggaacggttctccctgtccgggggtgaattccatgaagaaataattatggcaagcggcagcaatcgcttgcgcatccttcagatactgcccattaccggtaagctgatagagcaaagcagccgactgcatcatctgaccgctgttataggcaaatttggcacgtcctatctcaccgtccaaacgcatgttgtcgaagtaaaggcagtctgttgtgtcctgcaatgttgctttagtccactcgtacaaactcttccctttctcaaaataggagctgtcttgcgtagccttgaaaagtttcagggcaaagacggaaccaggggcgttggaacaagtgttctttgattccttcttctgttcgcaccaatagatacctcctcccaaacaatcgtccataccgctttctataaacttccagataagcttggcgctctgcagatagttctcttggctagtcatcagatagacgtctgtgaagtcaatgccgagccacacgttgtcatcgtaaaagcggtcggacaacggagcgtccttgatgtaagaagcatacgcttcgggcatacgacgagtatcgaaatattcagcaagtcccggaagcaccttctcatcaagcaacttctgatagttcccgaaatctttcttgttatctttagtggcctccatcaacgcattcactgcggagaaggtaccggaataaggccacaaataagagtagagattgggacggttcttctgttcctcggaagccagataagtagcggtatagccttccacgtccgaaggataattctcacgcaacagacaagtgcccggtgcggaatagtgagcatataaggaatcaagtgtttgtgtagatctgaccagcattgcgttgtctgccacagccggttctttctgtgtcttgcatccggttactgccaaggcgcatgccaataggcagaggagtgctttcttggaatttttcatcttttttctacggcattaaattgttcgacttgtttttcactccgttgcaggagtcttcttttatataatatataaaccctattaaaaacgattgcaaaaatagacagtaaggttaaaagccaactataaatccgtgacataaccgtccacattccggacatggcagaattctaaaacaagtttgtcacaaaacagacacaccgtttcccccatacttcggaaacatcatttcccaacaactggaaattctgaaatacgcagggttgtacaaccgtagggtatcagcgtgatttcttgctctcctccttcggcactgccacagaaagagaaaggctggggccctgccatttcattatatactgtccaagtagggataagacgagccttcatctttatttcaaccggtgcattttcctgattccaaggaaagtccaattgctgtttttggctattgatacttacttgggccacctcgttcattctgttacggtcaaaatccaccaatccgtagttccatggatccgaagaagtcacctgataataataagaaccataccaactatccttaaactctttcttttcccaattttcttccattttcagggcatataccaacggacctctttcaatagatactgcgttttcataccaagtgctagtaaagacctccatgggcagatacagttcaatcttatcattccgcttccatatacggtctacgatagctattttcccacctttgacagtttgctccatctttccatttacccgtatttcagcttgcttgcaccacttcggaacacgcaggtgaaatggaaatttcacttgtttcaccttattcctcacctctttaatggtaaaagttatctgatgatccatcggatagtaagtatcttcactgataaccaccggtacattatcacccacattggctgttacttccgacggagaatagacaatggctgcaatgccgttatcaggtgtggcataccataggtgctgtgtaaattttggccaaccttggtgcatattcgaaaaacaacatgggtatccggtcagagtgccaaaagcaaggtctgtcccttcatgatcctagtcgaagttgcgacgatggcgtgttaccatcacctgattcggttgctggaaatattgcttagtcataaagtcatcggatatttgggctggtaaagcattaaaagcaatgcgttccaaatggtcggcaaagtctatgtctcctgtaatctccaccattttttccagcgagtacatcaactctacggccgaacacaactccgagccttgtgtaggattgtttccatgcaaagcctcatcgcctccatacatgccttgcggctgtccgtggaaccggcgaatatctcgaaagccttccttgacagcatcaatatatttccggtcggtatcttgctgataataaataatcggttctttgatgccttgtgccaaattaacacagtgtatagtgcagggtctgcgcaagtctcccctatctaccatatctatgaaactgaaactctgccggtgcagcaaatgccccaattcaagcaaaaaatcctcccccgtaagattataaagccaatatacagcttgcaaattgtcacaagcacggaattctgcccaactgctccagtgtcctaaaggtttttgcggcaaggtattcagttgataacggaaatattttgtcataaaagcgacgactctcttatcgttcgttgccgaataatactgctgtaggattttcagcacgaccatacgcggccaccagtcttgcgagttatcacgttgcagtccaggctctcccggataatctttttcaggaccgaagaatccgtcctcacgctggctctgcaaagcccattctatccaaggttgcactttggctttcaagacatcatcatccagtatatacgccaaaggaagtagaccgtctatccagtatggaccgcgttcccactggtctccatcaccacctaaccaaccattgcgtttgcccataaccgaagggtaaagaacatccatctgaccactggcgccatttttctgacgaaccagcatttcgtgcaaccagcctttaggtttgatactgcctaaaggaagttccattaagggcttacggagtagaggatagcgattattcttgtagtttccttctactacctggctcaaaagagcatccacttgtttctccgcctcaggcgtaaaccacttttgagcagatattgtaaagagattagcagctaataaacatacaacagcaaatattttaattttcatttttcaaggtatttgttatttccaataaatttacttcaatagagttgttaacttactcacattaagcacttacacctgagaatcatcagatccttgtgtctgtggtgacagacacaaggatctgaaaaatgggaatataataactgtttattcgtatacttccatttcataaatgcgcacatctttaccagaagccgattgcatgggctgtgtcactaaaagacgcaggtagcgaacactttcagacttatttagcgtgcgattcagtacattcttaccattaccagaaacatagtccagtgtgcgccattcaccattcttgtcgctcttaccttgcagaaagcaggaggaagtgacgtaggaatggttttcgccggcagcgttcagtaacttccagccattaatgcttctttcaccgcccaaatcaaagtctacgtagtggggcatttcagcaatagcacaccactttgtgttttcgtcgccatctaccatgaaagccggcttctctttctcgttcacatagcttgaatagcccattaccatgtcctgcttcagaatgttcactctctctgtggagctttccgtctgatagcgattgcacttgtttgccgtacggaacagttcggaagcgggacaaacagaagtagcagcaacatcagtcaaagtggcggcaaaaataacaatatccttattatcgggcaataccacctcagtagccttttctggcaggtctattgcgaacttaaacatgtaagtgaactcatacggctgatcgccttcaccggaatggcggtgcgtacccacataggcaacttcagcatctttcagataaccttccgtatgtccggtgtgcccccactgaccgatgaagccagtataagaaggaacaatgacttcctgcacatacttgcctacgcggaatatccccttcacatctttatcagaagcggcagcagcaaggatatagagtctgttataagtacagtcggcgggcagtttcagtacattgcccttgcaagccataccattcagctcttcacgtgtctccaatttgaaaggcactccatgcacattcatctcggcaggtatcaattcagcagcataagaataaccagactcaaagttggcagcagccttgaactcgttccaactgaagcacttcttatcataaacaaggggcaatggttcggccaccgtctgcacctttttattggaagcaaaacgtaccttgtaggtcttaatgctgtttggattgactgacacttccaagcgatttccactgaatgtagccttaccgatggtcttttccgtaccatctgcttctacagcagccacaaggttgtcggcaaagacaatcgaggctttctgcgcctgcttgcctgcggcttcatacacgcgtaccacatattcatctgaactttcggctttctttaaggctttaataagtacattccggttatcggaaaaagccaatgaatagctcttacctaattcgccgcgatgctttccaacaacgaacgccttgatgcgctggttcagcaactcagcattctcgcgggtttgaactacgtctaaagcgcccacatgacctaccaagctgtaagtaaaggtatggtgaccgaagtcctgacgatcttgataagcatagttcttttttgtcttcggagtgtgcagcaaagtgagacgcagggtgttgttatcaggcttgtcccagccatatttgctgtcgttcatgatggaaacgccataagaaccgttagcgtccgttaaatctgcccaatattgagcatatacttcgtaagcggtcaagatgttgtttcctctctgcacgctgcctacgcccaagtcgtaagtggccacctcattattcaaattgaggggaaactcagccttcaacagagcgttggtagactgccagtccacttcgttagtaaagtcaatgcggtgggccaatacaccttcatacaaatggatgtactggcggaaaaaagaatcatcgtgacgtttctccacgcagagagtcttacgtaatgcaccgttttcgcaaagagtcactttcacatcctcggtgatggagataggagtagcgtccacagtctctttcaatatctcccatgccggccattcgaatgacttgttttcagtgaagagggctaaacgaatagccttaccagcctttaccaattccttgttgattctcttgtcgaacagtgaagtaatgtcaccgttctcattcaatgtcagtttgtagaacgaattttcaacacttgcagcttcaacagcagacatctcttttccttcgccggagaggcggacatcgtaaactgcgtatccattggcgggtacagtggcttctactaacaagcggacctttccatcagtatatgaaaccaactgagaaaccaccaacttgccttgttcgttatatacagccacacttttgggaaaacgagaagcctccacttcgatggtcaccacatctgtagccttgaagcccgaagcgttatagagcactacgggaatccccttgacacgagtatcaagcttgcctgccacacttcccacagaatgagtcaggatactggagaactgtttcagagagagaagttcatcgttccaagaaaattcataggcacggggaatgctggtaccagtcaaatcatcgtggaattggtggaatatgaagcgctgccaagactccgtcagactcttgccaggatattcggcaacccccaaaagggcagcagccacagaagcacgttcagcggcatcacccaaaagttcattttgacgattatagagtttcatagcagcctgtgatgtgtagcagccggttccatgaacgtccatcagcaattcaccgtcaaatacggggagctcgggatggctgccatagggctggtaatccttgaacaactggtcactggctgcactgataatcttcaacggaccgtctcccttgatacctttctccacggaagccacagaagcgatggtaggtgaaccgcccacatcacctgttccatagtagcggtaaacggtattcaggggagtgcatttggagagttccatcaaatatctattttctgaaaggtcttcattatcccaacgacgaccgtaatcatatccgtgagccagcatgacggacgctccatccactcctttccacagtccgatggtaaagggatgcttgctcttaccgtagaaaggattgttacgccaatccagcttctgtgaagagaaacctatcagtccacaatgggcagcaacagtaggcaatgtccaaccgaatccgaagcaatcgggaaggaagatgtcggtactttctacccccagctccttacgatagaactcctgccccagcataatgttgcgaataaacgattcaacagacggcaccaaagtgtcggtagcatcccaactggccccactcacatgccatcgacctgcctttacaaaagccttcatcagttcgtattcacgaggataatattccttcatccaagcatatttcactccaccttcaaaattaaagatatagtcggggtactggttcaaaaggaaaaggttctgattcaaggtattccaaacataatccttaatagtagtctgaatgtcccagttccactgcgtgtccaagtgggcatctgccaccatgtacgcttttgctttcttcggtgcaacggtctgagccgataattgtcctcctgcaacggccaacatcacggctcccgctatcagatgggtcttccccatcagtattcgtctctttttcatggttttgttattattgttttttcgtaaaagataatgtcaattcgatataaaccaccgcattctttgttataaatgtgctgcctcctctaaccgcaaaccgctctttcaccttctctctttagcctccatccggcaacaatagttttctgacatgtggaatgttggtaacaaaaatagcccatccttcactctcatactgtacagattcgcgacatagatatgtaaaaagtcgtctgtggcatgattttatatatttatgtcataaatagcatacatttcctacagaatacaaactacttttgtatattgtaaaaatccaaaagctaagaacatgaaaaaacaattcctactctcggcagttctctgcctctcactgaccgctttcggacagaaagtacatcaactggcctcacccagcggaaacatccgcatctcggtggagctgaccgatcaaatccaatatgatgtaacccaaggaaatcaaacactgatggacaactgtgtcattggtctggaaactgccaaccaccagctgggcatccatcctaaactaaacaaagtagtacgccaaaatgtaaacgaggaactgactcccatcgtacccctgaaattctctactataaccaaccgctacaaccaattgctactgaagtttaaaggaggctattcagtagagttccgtgcctttgatgacggattcgcctaccgcttccttactgacctgaaaggcgagcaagaaataatgaatgaaatcctccgcctgaactttgtggatgattgcctgctacatcttcagcaacctgacggctttaagacttcctatgaagaagaatatcgccaccaaacaagcagcgagtggaaaaactccaatcgcatggctctgcttccccttttagccagcacacccaaaggtgacaaaatcctcatgagtgaaaccaatctgacagactatcccgccatgtttctgaaaaacgatggacaaggcggcattaccgccgtcttcccccgtctgcctcttgaattcggagaagacggtgaccgcagtctcaagattctgaaagaagccaactgcatagcccgtaccgcaggcaagcgcagttatccatggcgttacttcgtcattaccgacgatgaccgcaaacttatagaaaacactctatcctatcgcctcgctgaaaagaatgtcatagaaaacacctcttggattaaaccaggactagccagctgggaatggtggaacggagccacaccctacggccccgacgtggacttcaaagcaggttgcaaccttgacacctacaaatacttcatcgacttcgcatcccactacggcgtagaatatatagtaatggacgaaggctgggccatgaacacccgcaacccctataaacccaatccctcggtagacatacacgaactcatccgctacggcaaagaaaaaaacgtaggcattgtgttatggctcacttggcttacggtagaaaaccactttgacctattcgaaactttcgaaaagtggggtgtgaaaggcgtaaagatagatttcatggatcgtagcgaccaatggatggtaaacttctatgaacgcgtagcacatgaagccgccaaacaccatctcttcgttgactttcacggtgctttcaaacctgccggattagaatacaaatacccaaacgtactctcctacgaaggcgtaagaggtatggagcaaatgggcggatgccgtcccgacaacagtgtctatttccccttcatacgcaacgcagtaggagccatggactatactcccggcgccatgcttagcatgcagcctgaagtctaccattccgaacgtcccaattctgccagcatcggcacacgtgcctatcagatggcactctttgttctttttgaaaccggcctgcagatgatggcagacaatcctaccctctattatcgcaacgacgagtgtacacgtttcatcacccaagtaccccaaacatgggacgaaaccatcgctctcgaagccaaagcaggagaatatgccatcgtggccaaacgcaaaggagaacaatggtatataggaggcatgaccaacaaccgcgaacgtgaacgggtctttaacatctcccttgatttcctgcaagaaggaaaaaattatctcatgacctcttttgaagacggcatcaacgctgaccaccaagccatggactatcgcaagcaagaacaatccttgaagaaaggcaaccatatcacagtccgtttggcacgcaacggtggattcgctgcggtcattcgctaatcatatccatacctatctgctccgtacaaatacatttctaaggatacggagcagatacaaagcaaactgtaagcctacaactaaagaaatatattgcaaatattgactgtttccaccttaaaatatatctttgcaacttaaaatcaatacaacaagccacatgaaagacatatactggaaaggccatacgattttattgcttatcagcctcttatgctgttttccggattttgtgtacgcttacagcctacggcaattctccaataaaaacggtctttccaatagtgccatccaatccctttaccaagatagccaaggtgtactatggataggaacatgcgacggactgaacgtgtttgacggcaacaatatccacctatatacgcccgttgatgtgtcacgcaacctattgtcaggcaacattatcagccagatcgtagaatcagagccaggcatactgtggttacaaaccaactacgggttagacagattggatacataccgacagacctgccggacctttaccgaattcaaggacaacatcttcttggcacgaagcaaaaacaagtgcatgttagtgctgaaagatgacggaaatctgtatcactaccaacaagagaaccagaaatttctccagttaaacatctcttccatggattttaataaagtactgtccatgaccattgattccaacaacctgctttggatattcgcaactggaaacaacactcgttgctatcgtctgaaccacacgggaaaaagcgtgacactgattccggaaaagccatttggacatcacggcttgaagcatgccttcatcggagaagattcagcctacttcattgatgaaacctatgccctctacgaatatagtttcagcaaccgacagtgttactacattgccgacctgaaagacgaaatagaaaaacgaggtgaagtatcttccatcatcaaacgagaaaatgacttctgtatcggtttcaaaagcagcggcttgatagtactgaaatatgaagcaaaccaaaagattaaataccgtatagaatacactgaaatacagtcgggcatcttctgtctgatgaaagacaaatttcaagatatcgtatgggtagctaccgacggagaagggttatacatgctttacaatgacacattcaccatgaccaacaccctgctcaacactcccgcatatcaggtgaacaacccggtacgcagcctttacctcgacccacagcaaaccttatggataggaaccaaaggcagtggcatattgcgtataccgaattatcttgtcaacaatacacccgaaaaacatgatcgtctcatcaccggtaacagcacattgaccgacaactccgtctactgttttgcacccggtggaaaagaccgactttggataggtacggaaaacggaatcaattattattcctactctacccaccaattgaaagaactggcggtacaagccaatggaaccaaagtgaaatatgtgcactccattgatcaaaccaatgacagtacactttggatttccaccgtgggcgaaggaatcgtaaaggtgacactagaaaatcagagaaaagatcctattgtgaagcatgctacacggactttggtgagtaacggacatatggcatcaaactattttttcacctcctaccgtgaaagcagctctacgctgtggttcgggaacagagggctcggagcctaccgcattgatgtacgtactggagaaatggcacagttccgcttcaacaacttggtaaacagccaaaccgccaacgatgtgttcgccatacacaaaaacgagcaaggctactggctgggcactggatcagggcttctccgcttctactcaaacgaagacggaaacccagacagcatcagtgcaaagctctacaccaacagcaccgtacatggtatcttggaggacaaccgaggcaatctctgggtgagtaccaatcaaggattaatgagactcaatccccaagaacagaccaagcagacctacaacaacggaaacggactggccgtgaccgaatttagtgatggagccttctacaaagacaatgctacgggaatccttttctttggaggtgtaaacggcttcgtcaccgtgaagcccgattcttacatcaccacggactatatgcccgaaatcagcctgaaaggactttccatcttcggtaaggaatacaacctgcatgactttttacattacaaaaacgggaagcccgtgctacaactggactacaaacacaacttcttccagctcaacttccggataacagactacattaacggaaacgactatttctactcctataaactaaaggaagcaagcgaccaatggatagaaaacggagtttcacccaatgccatcttctccaacctttcccccggagaatatactctgtttgtgaaataccgcaacaacatcaacggtaaagaaagccatccgcaagccttcaccatttacatcgttcctccctggtatctcagtacctgggcctatgtgggctactttttgttagggttactattatgtacaggcatagtcgcctatgcattctatacctaccgcctgaagcggcagcacatgatgaagaaaatggaacgacagaaaaaagaggaagtctatgaatcaaaactacgcttcttcaccaacatcacccacgagttttgcacccccctcaccctgattcagggaccgtgcgagaagatactcacccacaaggagacagatatctacacgcaccgctacgccaagatgattcagcaaaatgtggaaaagctgaatggtctcattgtggaattgctggagttcagaagactggaaacggaaaacaaaatgctctccatacagccgcaacctgtttccgaaaagttaagggacatcgccgaatccttcggtgacatggcggaaaacagagaaatgaactactgccttgacatagcccccgaactgacatggaacaccgacctgagctgcttcaacaaaatagccggaaacctcatatccaacgctttcaagtacacacccgacaaggggaacatcagcgtaacattgtacacgaaaaacgaacgtcttattttgaagatagccaataccggcaaaggcatcacaccggaaaatctcggaaagatattcgaccgctataagattctcgactccgtggagatgaacggcaaaaactcaagaaacggactggggttggccatctgcaaaaacatggtgaccctgttggaaggagacataaacatcgaaagcacaccgggcgaactgaccaccttcactgtaagccttccctcgctccccccaaacggacaagaagtaccgcaaactgcatacgaagcggcttctccaagcattcccaccgaagaagtgcaagaattgcccgaaaaatacacccaagaattcgacgcaaacaagcagacggtcatggtgatagatgatgacccttccatgctgtggttcgtatccgaaatattcacagagaaatacaacgtactctctttcaataatgcccaaaaggcattagacagcctggagcaacgacagccagatctcatcatctcagacgtgatgatgcccgatatagatgggttatccttcacctccaccatcaagcaacacaagctgtggagccatattcccctaatcctgctctcagcactgcatcacgaagacgaccaagtaaaaggactggaatcgggggcggatgcctatgtcaccaagcctttcaatgtgaaatatttggaaaagatggtctatcatctcatccgccgcgaagaaaacctgaaggaatattatagttcggcactcagcacctttacctggaaagaaggaagctgcttgcacaaagaagaacaagaattcttagagaaaatgacagaagtcattgaaaagaacttagccaatccagacctgcaagtagaacttttgagtaaggaaatgggctacagcagccggcagttctaccgcaaactgaaaccacttactgacaaatcgcctgccgacatcatcaaagaataccgcctctccacggcggaacgcttgttagtctccagcaacttcaccatcgaagagctgatggaccgcacgggattcaccaaccgaagcactttctataaagctttttcacaacgttacggaatgccaccccgtcaatactgcgaacagcaaaagaagaacgtgaaggaaggacaggaaatcactaatacttaatcatcttataccatctgtatttatgaaaagaagctcttttttgagtatcgcattcaccgggctgcttgctaccgcaacagcacaaactcacgaacaacccgaatggaatgacctgaacatttcgggagtgaacaaagaaacggcatgccaaaccgctattccctttgccgacgaaggacaagccctacgcctgagcatcgaggaatccccctattatcaaactctgaacggtacatggaaattccattgggtggccgatcccgaaaaacggccgaaggatttcttcaagcccaactacgacgtaagtggctgggataacatcaaagtgcccgccacatggcagatagaggctgtacgccataataagccctgggacaagcctttgtattgtaataccatttaccctttctgtgattacagtaaaggagtacaatggcccaacgtcatccaacctcgcccggcagactatacttttgccaacatgcccaatcccgtaggcagttaccgacgtgaattcactttgcccacatcttggaaggacagagatgtatttattcgcttcaatggagtggaagcaggtttctatctttggttgaacggtaaaaaagtgggctattcagaagacagctacttacctgccgagttcaatctgactccctatttacaagaaggaaaaaacacattggcagttgaagtgtaccgtttcaccgatggaagttttcttgaatgtcaagatttctggcggttcagcggtatcttccgcgatgtattcctatggtcagcaccacgcacgcaaattagggacttcttcttccgaaccgacttggacggagattatcgtaatgctacagtttttttggacgtggaaatcaccggtaagaaaagttctgccgaactcatagtgaagctctccgacacagaaggaaaggaagtgctatcacgcactatccacgccacaaaaataggtagtacccatctggaattcgatgtgaagaacccactgaaatggacagccgaaacacccagcctctacaacctgaccctgaccctaaaacagaaaggaaaagtgacagacctacgtagtgtaaaggtaggcttccgcgaaatagagtttgccaaaaacggacaactgctgattaacggcaaacccactcttttcaaaggtgtcaaccgccacgatcacagcccattgaatggccgtaccgtctccaaagaagagatggaaaaggacgtacaactaatgaaagcgctgaacgtaaatgctgtccgtacctcccattaccccaacaacccttacttttacgacctatgcgaccgctatggcatctatgtattggcagaagccaatgtagagtgccacggcgaaatgcgtctctcacacgagccacagtgggaaaaatcattcaccgagcgcaacgagaaccaagtgaaacgtttccgtaaccacgcttccatcgtaatgtggtccatgggcaacgaatcgggaaacggaaacaacttctccactgctgaaaaggccatcaaacgtttggatactacccgccccacccactacgagggaaacagttccttctgcgacgtgaccagttgcatgtacccaagtgtggactggctggaaaacgtaggccgtgaacgattggagaaaatacaaaagggcgagatcgtgaaacctcacgtagtatgcgagtatgcccatgccatgggaaattccataggaaacttcaaggaatactgggaaacctacgaacgctatccggcactcatcggaggtttcatttgggattgggtggaccaaagcctgcgtatgcccactcccgacggcaaaggcttctacatggccgtaggcggtgactttggtgacaagcccaacgacggtaacttctgtaccaacggcgtcatcttctccgaccgtacattatctgccaaatcctatgaaatgaagaagatacatcaacccatccgcatagaagcattagggaatggcaaatatagaatcagcaacaagcgattccatgccaatatggaagacctctacgggagatacgaaataacggaagatggaaggaccgtctgctcaggcaatctggaagatttgaagctggaagcacaggcaagcaaagtcatcaccctgccagacatacccgcaacgaaggtacccggagcagaatactttatcaatttcagtttctgccaaaaaagagataccgaatgggcaaaagccgactacgaggtagccaccgaacaattcaagctatcaagcagcgagaaacctatattcgtacccgaaaaaggaaacatcaatctaaacgaaactgccgacgcattggtggtgaaaggtgaacgttttgaagctgtcttctccaaggaagaaggaactttatcggcatatacattgaataatatccccctgataagtaaaggactcgaactgaacctcttccgtgctcccaccgacaacgataaacaggtaagtggcgattggcaacgcaaaggcctttaccagctgcaagcggaaaccggcaaatgggaaacccaccaagaagaggacagaataatcctgcacatccggaactgccacaaaggtaaactcggttttgagtatcgcacagaaatagaatacaccgtaaatgccgatggttccatcatggtgaacagtgtcatcatcccggtatccgacagcgaaatcattccgcgtgtgggctatcgaatggaactgcccgaaggcttcgagcgtatgcgttggtatggacgtggcccatgggaaaactacgtagaccgcaaggatgccaccccaataggcgtatacgaaagtacagtatccgaccaatgggtgaactatgtaaagcctcaggagatgggtaaccatgaagaggtacgctggatttccatcaccaacgccgacggtatgggcttcgttttcgtggcaggcgaccaaatggcggcttctgccctgcatgtcagagcacaagacatggcagaccccgaccatctgcaaaaactgattcacaaatacgacatcccgatgcgcaaggagacagttctttgtcttgatgcccacaatcgtcctctgggcaacgcaagctgcggtccaggcccgatgaaaaaatacgaactgcaagcaactcccgtagcattcagcttcatcatgatgcctttggaaagaagctacacgcaaagtgagcttaccaagaaagcacgcgtacagatgcctgcatgcatgcccgtaatggtagaacgcgataacaacggttacctgcaaatgagtaccggaactccggacgcgaccatcttctacagccttaacggtaacgaataccgggaatacacagctccattcgagttcattgacggtggcaagatacaaacatacgctgtttctggaaaattaggcaagagcctggtcactactatggaactacccatattcgtagaccactcggcatggaaggtggtctcctccagcagcgacagccaaggagaagaggcgcaaaacgccatcgatggggacccttccacgtattggcacacccgttggcacgaacccattccagagtttccacacagcattgtggtagacatggcttccctactggtagtggacaaattcatctacacagcacgacattccaatgataacggacacgtcaaagactacgagctaagcttcagcaaagacggaaaaaattgggaaagcaccgtcaaaggtacattctccaatctgacgtctgcccaaaccataacattggaaacacccgtcactgcccgttacttcaaattcgttcccttgtccgaaatgcacggcaggaaatgggcttcggcagccgaactgaatgtgagcatcctgaaaaacatcagcggagcatcccagagacaaatagtggtctccgtagacagcgatgcagacaacagcatgaagctggcggcagacggtaacataaacacctattggcacacggtacacaaccaattctacatagctccctaccctcatgagatacatctttccctatccaaagaggccactataaagggtatccgctacactccgcgacaagatagcgaagaaggacggatagcttcctatgaagtatatgcaagcaaagatggaaaaaattgggggcagcccattatctatggcaccttccatataggtacagcaacgcaaactatagaatttactccttgccgggcacgctatgtgaaactattgggattatcggcccatgacaaaggaaagaaagctgccatagcagaattagagataatcttggaagaataattttagaggaaaaactattaaccatggagtttcagggcttgtgcaaaaacttgtacaagtcctgaaattccacgttttctcctataagtaaaaatcactttcccttcactatccgcttaatatcattcagcttgttcagtgcctccagcggcgtcaagttattcacatccagattcagtatctcatcgcgtatctggcacagcaccgggtcgtcgagctgaaagaagctgagctgcataccaccgcgtgtctctcccacttccaccatcggtttgctggaaatcccctgctggcggttgtctgtttccagttgtttcagaatgtcattggcacgcttcacgatgcttttgggcatacctgccattttggctacatggataccgaaggagtgttcgctgccaccgcgctccaatttgcgcaggaagatgactttgttatctatctccttcaccgaaacgttgtagttcttaatacgcttgaagcttttctccatctcgttcaactcatggtagtgcgtagcaaacaaggttcgggcttttgccttgggatgctcgtgtatatgctccacaatcgcccaggcgatggaaataccatcatatgtagaagtaccgcgtcccagctcgtcgaacaacaccaagctgcggggagaaaggttgttcaggatatctgccgcctcgttcatctccaccataaaggtagactcgcccacggaaatattatcgctggcacccacacgggtgaatatcttatccaccaaaccgatatgggcactctccgcaggcacgaaactgccgatttgagccagcagcgtaatcagcgccgtctgcctcagcaaagcggacttacccgccatgttgggccccgtaatgatgataatctgctgcgtctggctgtccagcatcacatcgttggcaatatacttctcgccgatggggagctgcttctcaatgaccggatgccgtccctgatggatttccagcacatcgtcgtcggcaatgacggggcgtatatagttgttctcgcgcgccgctgtggcaaaggagagcaggcagtccaaccgtgctatctggtttgcattgatttgaatggcaggaatgaactcgctcaatgattgcaccaattctgcatagagttgtgtttccagcaccagtatcttgtcctccgcgccgagaatcttctcctcgtactccttcaattcctgggtaatatagcgctcggcattggcaagggtctgtttgcgtatccactctgccggcaccttgtccttatgcgtgttgcgcacctcaatgtagtagccgaagacattgttgtagcctatcttcaagctgggaatctctgtcagttcgctctcgcgctgctgtatctgcaacagataatccttgccggagtaggcaatccggcgcaactcgtccagctcggcactgacaccggatttgatgacacctcccttattaatcaataacggcgggtcattgtctatctcccggtcaatgcggtcgcggataaactggcagatattcaactgctcgcctatatggttcaagctggcattatcggcatccatgcaagctgccttgatgggttctatcgcctgcaaagccaccttcagcgccaccacctcacgcggagagacacgccctaccgccactttggagatgatgcgttccaagtcgccaatcaaatgcaactgctcttctatcaactctttgaaatcgggctggcggaaaaagtattccaccacattcagccgctcgttaatcggctgcacgtccttcaacgggaataccagccagcgtttcagcaggcgggcacccatcgggctgatggtcttgtctatcacattcagcagactgctgccaccgtcgttcatcgaccccatcaactccaggctgcgcaccgtgaacttatccaggcggacatacttatcctcctcgatgcgtgccagcgaagtgacatgccctatctgcgtatgctgcgtcatgatgaggtattgcaggatggctcccgaagcgatgataccgttcttgagatgctccacaccgaagcctttcaagttcttcacctcgaaatgcttcagcagcttttcgcgggcagatgtctcggtaaacacccagtcgtccaactcgaaggtgaagaacttgctgccgaagtttccttcgaacatcagccgcttgccacgctcgaaaagcacctctttgggggcaaagttgttcagcagcttgtccacatagtcgaaaggtccttccgccgtcagaaattcgcccgtagatatgtccaggaaagccacaccgcaggcacccttaccgaaatgcacggcagccaggaagttgttctcccggtagttcagcacattgtcgttgatggaaactcccggcgtcaccagctccgtgatgccgcgcttcaccagtttcttcgtcagcttcgggtcctccaactggtcgcagatggccacacgcttgccggcacgtatcagcttgggcagataggtgtcgagcgcatgatgcgggaaacccgccatttcgatggttttccccttgccattggcacgtttggtcaaggtaataccgaggatttcggacgcgacgacggcatcggtggaataggtttcatagaagtcaccacaacgaaacagcatgacagcatcgggatgctttgccttcaagtcgaggaactgcttcatcatcggggtaaggacaatatcttcgtgcatacaagtctttaatttttaatttccaaagctttgagccaagagagcaggaaatcgtcaagtaagacccaaaacttaatgtgacaaagataattcttttttagaaaacagccacggagaggcttcaaaaccttagcaagccttaacaaagagacgcattttcctaaaacatgttataaaacagtcttttttatttgctttatttggagataagcaaaaagttcgtacctttgcaatgtgtttttcatagtattagatttaaggttaacaaaggttggagtacagcggtactcctttttttatgcccatacctttcgtatctttccccttttcccttacaaaagtacatattcactcggcgaaacgccctttatcttcttgaaaaccttgttcatgcgatcccaacaaggatgagcaacagttgtctcccatttactacattccctatttaagcaacaattcctgcaatactgcattttaaattcttgcttactaaaacttattcgtccgacagccgttgaattatcgtccgacaattgtcggacgataattcaacaagtatcggacgaataaatcttagcaaatagaaagatagatggcttaccgcttgatttatttgtgattatccgcgcacacaatcagtacctccccaaaagaatcaagttgccaatggggtctcatagagattgtcattgcaacttcaggaatggcaacgtatttccaccggtagacaacggcaatttcccgtcccatttctccacagcctttagttgaatcaattccggcgtgatgctttgttgaaggatacggttggcatctgccttacccttggcggcagctactaccttttccgcctcggctatagcagctttcttttcattctccaccttcaaggcattctgcacagcagtattcttttcgtcaatggcagcttgcagcacatcgttgggtttcacggacgactgtatgttggtaaacgtaaagccacgggtactgagacgctccttcagtaatgcctccacctccttctcgaaagccggacggttgttgatgagcgaatccgtctcatagagtcctgccacgtccttataagcgttcttcacttccgtcaggataacactctgttccaattcttcggtagtcttgcgatagcgtagaaaaactactttggcatcctcccgctcaatgaagtattctatagtagggtctgtcttgaagatggttcccttcttgtcctgaatgtcgaaaggttcgtagtctacaatctgcgcaaatgcaggatattcgaatagctgcttggcaaaacggttgtaaaccacccatccggtctccaccttggcatcatctactccacgctcactaccggccagattgacgatgatgcccgtctgtcccgaatcaatacgctccacggcaaacatgaccaagaacaatactataattccaatgactgcgactcctgccgcgcctactctcactgttgatttgtttgtgactttcatggtgttttctgttagtttaatgagtgaataatgctccaaagatatttataattgtttgttcaagaaaggcaatccgttatttttggaagagaagaaggcctccctcccgcacacagtgtagaaaggaggcccatagtctctatattttcagaatttactcagtcacgatacgacctgccaacagtgatttcttcagataactttcagcacactataggaattaccctcactcccactggacatggtgctgatttcctttgccacttctttcagtcttgccggattgctgtatttatatataattgtaggatatacctttttacagaattctgtgccaaattacttaaacgttcgtgtttgcgaaataatattgccataatgtcttggtttttaaaataaatagaatagaaatcgtgttttcttatttctctgccaataactgcacagattcacccgtcatgtgatggtgctgtcaagctccagtcattgttcttttcgtcccattcgtagctgaggtagcgcaggacactgctgtcggtctgccgatagacggctttctgcttgatgtcggtgtaggcactgctttgctcgttccagagggcgtattccacagtgacgtcgtccgtatagaagaagttaagactgtggtgcttctcaaagctttgcgtggattcgttccatttcagcacttctttttgggagatgcgaccggagttgtcgtaaatgtaattgtacttcaagtggtggtgcagaaatttctgattctccactttgaatacggtttgtgtttccacacggccgtcgttggtttcggtattataggcaaagttgtctgtacggttaacggctgctgcgcttactacgtttactaaagaggtcattgcgatgattgctgaaattactaaagtcttcataatggttctattttttaagttatacattttgttttaagttcttgtcttcggggaagttgttccctttcgacattgcaaagattgagggaggtaaaaagcttttaggttatcgttacgttaatgttaggttaacggagatatttattacttttgcgcccaaaacaagaacaaaatgaaaacacatttcctcttatatctttccttttttcaatctatcggagacgtaactggataggcatacagcagactgccaccacatctactattgagaagtagcatttttcttctatgtcgtcccaaacggttcggactttcttcgcttcgaaaaacttgatggcattatgctgggccatgatattatgttttcaattcttagttttaaactctttgattgggtcctcgttatgtgacagaaacaatgctctttcttcaatttaatcataatttctgctttattgcatcgttgacatggtctgttttcttaggtatagtacaaaatatatgattattttgactataaaacaagtcgcagtcaataaatcactgcacatcatatgacaatagggaatagcctgcaccacagcccattccctattaccttaattctacttgtgtgacttcctcttacttcaccacaccgtccgtcatcgtaaagccttccaaagagccggctttcacctgaatacaaatcacactgatggcgctgtctgccgcagccgacaattgtcgttctcctgccggagccacgcgaagccagtcacccgcctgcagttctacgatttctccgtcaaccaccatggtgccgcgtccggagaggacggcataaatttcttcattttgcttgtgcgaatgcacaaaaggtactcctgcaccagccggcaaattgctgatagatacttctgcaccagtcagattcaatgaatcgtgcaactcgacacgtgcctcgcctgcgggcacatttactttctgatagttcttcataatcacttctccttagtatgttttgatttacggttgcaaagttagccaactactaaatatcgtacaagaaggcacttgaagctcagttagttacctccatgttaccattattggcaaataaggagttagaaaaataagattaacaaaaattattactatttttgccgaaaaagcaaatatcgactaaactctataaaacatgaagattctgaaaaaaatttcaaaagtaatagtcatcgtaatggctgtactggcaaccatttggtgtggtttgtatgtttatgccaactatttctataatgacaagcagattgatgtagaaaacttctacatcgcggaactaccgttacccccctcgcagtttgaagaagatttcaaagaaatacaccagattgtcatggagaattattcattataccaagccaagcatctgaatatggattcattgtatcaagcttgtgacgcccgcgttcgccaggcgcagaccaccacagactacggactgatagtgcaggaatacatctctgccttacaatgcgcccacgccattacctgctacaagaggtacacagccaatcagcgcgtagcctttatagaggattccttgttcgttgacaaacccagtgactatctgacagaatacggcttccaggacaaagaccggattatagctatcaacggactcccctataaacaatggattgaacagaacgaaaaatataccgaagcatctaccgtcccccacagacggctccgtacagcctatgatgcgttccgtagttatgcagacaccctaagaaactatacactgctgagagggggcgatactctgaccgtcacccttcccttgaaacaaagggactattttccggataacgaagaacaaactgtggagagcaggatattacaagacagcattggttaccttaccatcaaaaccatgatgaaccccgtcatggaagatttcaaggcggtctatcccaaagtcaaggatttaccatacctcattatagacgtacgtagaaacggcggaggaaacagcatgaatggagtaaacatctgcaagtacttcatccgcgaagcacaaccacactgcgtcagcaagagctacatcatgcagcccgaagccgacgcctataaaggtaaaatctatctgctgaccgacacatatacgctctctgctgccgagagcttcacactcgacatgaaggaaagcggaaatgtcaccctcatcggcgaagctaccggaggggataccggcaatggcccccgtcctttctgtaccaaacagcggacctatttccgtatccctacccgccagccggacgtctcttctaaaggtttccccatggaaggtataggcataccgccccatcatcaagtatcccaaaccgtagcagatttcatgaaggatgaagatacagtgctgaattatgctgtcggactgataacagagaaacaataatacatttcctcaacgaaaaagagccaagtatcaaaggtgtgtcacctcacgatacttggctcttttgtatttgatatattatcctttatttggtacttgccaacatcaaagccgcattgctgtcattcagttcgtaaacggtagtttgcgtatagctgtcgtaaccattagttctactgttccaacgggcatagttcaactcaacttcactgtcagtgtattcaacatccagcttgaaataaggcacccaggcttcctttacgctatcccacttgaaagcttccttgctcgtcacacggttctcactgtcataagtgtaagtgtagcggaggtgacggaaaaggtgtccgtcctcattgcggaagatagtcttggcggtcatcagttctccggtcatctcctcgtttttcacataatcggcaggagttgtcgcgcttgcagaaaagttcattacacttgccattaccactgccatcattaccactgcttttgaaaatactgttgctttcataatcgttattttttattgttattacttctttctctgaggaggttgttgtttcataaccgccttcgcctatatatagtcaatctgcgtgccaaagaattaaatcactgattatcaaagaataactattttatagtaatgtccattttcggacaactgtccgcacaaaaacgaacagcaaaacaaaaaataaacgaaatatcatgaaagtatttctacattagcaataatattatgtaacagtagtaaactgtttgatgattgtccctacaaaaagctgatttatacttatcttatctcaatggcggcatctgaaaacgtggtggggcaatagtcgctccgccactgccccctctattatcaaagacggtgttacgcagaatctcatacaagattccacctacatccagacttaatttaaacttgtcgaaattataatagggaatcacaacgggaaccgtctcccaacgaccgcgataagcatcgtaataacgttgtactccaacttccataccaaaacgttcggacatatccagagacatggtggcaccgtagcggtgggtatccatcccgtaagtatttcctatggcatacgaaccgaaaaccttaaaagctacacggtccgaagcctgataccgcaaagctcccgaagtactgaaagcctgcccggtggaatgaatcatatttatcttcatggcatctacgccaagctggagcgtcagcctttggttaaaggcatgctgatatcccagggaagcattgttgaaacgtccgatacccggtacgctggtctgcccaccggaaccgaataacataccgtgaggaaactgtcttaatacaccgcttgtactgtaatctccccgaaatagcagggaaggattggtctgataaggcagacgaagagactctttcagtgaaaaatcgggcagggaataggagtgctccggatgaaacatggaagaaggggcagagttttcagaaggaagctcaaaaggagagaatagagattcattgaattccggctgtatctgtatactgtcacgaatgaaacgtacactgtcttcctgcgcaaaaagcaattgcggcacaaaagccaacagcaggcagattcccaaacggccaccaagacaagagatactgactttccgttttatacacatataccctccttctttatattcatataatactgctatacaaaaataacgaaaataaaccagaagaacagtacatgtactgctaaattattgcaatatagaaggatacattattaattttctatcagtatcaatcctactcctttcactgttttaatggttaccgactcgtcttccgaaagaaatttccgaagtttcgtcacaaatacatccaggctgcgggaagcaaagtaatcatcttccgtattccagaatttatccaagatagcttcccggcggataacgtctccccgcttctcacaaagcatctgcaacaaacctgtctcgcgcacagtcaaagtcttgtttacacccgaagcatgtttcaaagtggcatgtgtggcatccaacacatattccttgcctatcttgtagcattgactcatgtctttcgatttttcgcctttggaaagcttcaataaggcgtggacatgtgcatccagttcttcgggaatgaacggtttctttatatagttattggcaccgatttcataaccttttaccacatctttaggagatatcagggcagaggagaacagaatcggagtttccccatctgtctcgcggatacgcttcaccatctcgtaaccgttcataacgggcatttctatatcagatactatcacatcaggatgttgttctttccactgtttcaagccctcctcgccattggcggcagcaatcacttcataaccgcctatcatatcttccaacccgccctgaactatatatctcaagcttgcatcgtcttctaccaacaataactttatcataatgcgtttattatatattgcaaaaataaggaaaaaaatgaatgcaacagtcatattgctataaaataaacgaggaaaacaacgcctcttaacctaatattaacgtagcgataacttatgaagcatgtgccccactctacctttgcaacatcaatacaaaaaatccacactatgaaagcagatatttcaataacaaaaagccgaaaagggacagagatagtagtttcgggcaagaggattaataaatacggcatcatagctgccatagtatttgcagtaccaatgctgattctgtttcagtcgatacatggagaaacaaccagttatctatcgctggtcagattcttcatgtgtatattggcagctgtcctggtaaatctattcctacataaactgttgttcagattgttttcgccgatacgcatgtggcaatatcgcatcacatgcctgctgcccttcctgctactgggtatattgccccttatatatggtatgacaagtggcaattatgatgtcacacgatttggaatattactggctgtcatgagtttcgacgacctttacatcctctggcaattacgctcattcggtggaggctcctatattactgacaaatcagaaggattgaatttccacgtgtggtaaatttatacagtctcaataggaaagtagagtgtaaattcactgaagcacccctcttcactttccacttctaccctgccgccatgtgccagcatcacctgctgtacataattcaggcccagaccaaaacctgcagcaccgccccttccacttcgcccgactgctgcagaacgttcaaaacggttgaagataagagactggtcttttaagggaatacccaatccgttgtcacacacctttatcttgcagaagcctttctccgattcgcaaataatatctatctttacctcttcatgggaatatttaatggcattgtccagcagattgcccaacacttcacgcaaacagaaggcatcggcatacaccatttcacaacgatgataaacggtcgtaaattctacccttttgctggttttcagagaaattttggcaattatatcatcaagtaaaggccgcaaaggcacctcttcctgatggagttccaaatgtccctcatccagcttggtaagtaccagtacacgattggaaagggtaagcagatgctcacactcttccatcatcgcctgccggtatttctcttcttttccaggcttaccggacaatttgccgctattcagaatatgagctcccatcaggatggaactcagaggagacttcatgtcgtgtatcatagcataagtaaaatccttctggaattgctccaaatgccgctgtgtacgcaaaactttcacctggccgagaatacagtccaacaccaccaaaaacatcacccaaagaggcagaaacagataccatacggaacttatgacgtagcgatacggattcttcaccacaccttgtatacaaaggatgctgtcctccttcaacggtataaaccgggaagaaatatcctgatattttgccgaggcatatcctgcttccaccactgtactatcggagggagcgtagtactggcggataccactcttataggtcattcccaaggcttccaacctggaagcaaaagcagaatcgaggtactgcacggagagaggaagttccattccgctttcattgatgctgcgctgcataatcaaagcagagcgtagtcgataattcaaatcgaccggattgtacatatgtaccactccaaagcggttcaccttatacttcgactggtctttctccagaaattccctttgctcctttgcaaaaggcgattcaacactctcttcccattcatcctttccatccctatcagtctgttcgtagagcaaagaaaggcggcgtttcaaaacctcgtcataaaaagccgcttcaaaacaatcatttacctgataggcagtttctttgaaagaagcacggtacagatagacaaaccagactaccatcagcagacagccggcaatcaacccgacaatcgaaaagactttaaaagaatattgcttgcgcacctgccgctgccgttcgctttgcttagctcccgtaagcgtatgttctgtcatgtccagcaaatgttgccccgaggcttctatatctgcccaccggctctccgatatctgactacgtacctcacctatcggcaacctcatcttctctgccagcacataaaaagcagaccgctgcttctcaatatcattaccttgtttaagtatggaatccatttgcctggcccaactgtacaccagaaaaacaaccaagagaagcgtaggaaggaacaaaaagactatatccttgacaagcggtataaaaggagaaaacatgacggcttcaatggcctctcctttcttctcattcaaccaggctttttccgaaagaacagacttgaaccgtacatataccgaacgcttacttctgtccgtcgcaggacggatatttacagtccggtctatatttttccatttcagtttcttctctaccaacctcgccatcacatctaatggaatggcgacatgatatacatcttcgagaaaggaagctgcctgctgatagtttaaaaacatctcatcttcgaaagacctgatactgtctttggatagatacgagtaaaaagggatagtcatgtcaggaaacggtaaattattaatctcgttgtccaccgtttcgataaaagccagacgaaaacattcgttcagtgcgcgttctgcctctttcttggtattgtcgtaagcatacatcataccaccaatctgcaccacaattaccagtagcagccctacaatagaaaggatatagagtgaacgaagtttcatcttacctattattttgaggacaaagatagcattttatcatagaaaaagaactgatacaaaaaagatagccttggacttttatttatccaaagctatccatacaagtacaatccctgcgatagagacgtctacagaattatttgcgaagagtcaacttatcaatcccaaagaaaccggtatcatgtcccggagccagtgcaatcgactcaatctgcaactcattctttcctttttccaaattgacccgcccaagattcaccaaaagcagagacacttctccattggtcagactgacttccggagtaatcaccttatcatttacacgaagggcaaatgtaccataatcaggcgccacagtgaactgtattttcgcataataagttccttccacttcactgtcaaaaaccaatgacagcttatctcccgatttaaactctttccagtagagctgcataccctcactccacaaggggtggaagttggtctgcaattcaacggaccccatatgccccggacgaggctgcatggcttcgccctccacaaccagactcatccctaaaccgaaaatatctgacggttggttggcaacccgttcgcgtacatcgctcacaaagggtttcggctgtatttcgcctctgggaagcatataccagaaggttatcggagcataattaaggtgtatattcgaccaatcgaataactccatgtcaaagcgcaggctccgggtaaacggaatcgcatccaaactacgaacacgggtattctgcgccaaacctatgtgagcataacaaccatctcctatgggttgggcaacaaaaggatggtttatccacggttcatagcgcccccaggcatagccataataatcttctgtacccgttccaaagtgtgacggaaaggtttcaccgtccacatacaccttttcatctccttctccccaccaacccaagttggggttatagacagtaaccgcatctcccacatacacgcccctacctttaagatcggcaaacgtaaggtcctgggcaaactcatcgccccgggcatggatatgcgtaaactgctgccatgtggtaccaaagtgcatggagcgctcatcccactgccactttccactaactgcagcagccttggatatctccaccggctgttccccataattggtcaaggtaatcgtacagttccgctcgaaaggcatcacccaccatgcactcatcacatcatcctgcacggcccgcgtataccacgtaccagttgcaacgggataatagcctaccccaaaaaactcaccgaccggagcccagacagttagttccccatcaaaggcaatggacaagaccgtagagcgaagtgcttggcgacggtcatcggcatcaatccgcatcgaaagacgacgaatggcacgagagccgtcaatcgtaaaactacggctttcacccggagccagagaagccgccagattgagcgtactttctcttcccgcaagcggagtatcaataccaggtgttccttccgacagcttcttattgacagcagctatcagccgggcattcttcttcaactctttggccgagaaagaaatcaccttgaccggagaagtataagtgcggtaattgatagcatagtatacaatggtcttactctcaattttcccctccggagtaatcttcaagtccggcgattcgatagtcaccttgcaccgcttggcataaggtatgggcaaatataaattatgccctctttcttccatcggagcctcatcgggtactgaagttgaaagaggttctccacaaaggacttgcccgctcaatatatcacgtacattgccttcaattaccggtttttcctcattgtctatgtagatacgcagagtcccttgtccccgatttatgccggagaaagtcatccagaaacgaactatggcaccggggccttcggcatccatcatcacatattccgtcctccctccgttctcttcctggcggataaactgtccttggtcgaaattaccaaaccaggcacgcttatccgtcatgttatgcgaactacggtcgtagctgctgaactgcttacacgtataggcattttcgggccaacgcgccagcacggaacggtctgtcatctcatgcaacaatgtcttaagagagataaccgggtcggccatagccaaaccgctatagagaaatatcaactgaattacaaaaactagttttttcatcataaccgattattttagtaaatctccatctcattgatgcgtaacacctttcctcctgcatgctgcataggacgggttatcatcaagcgtacatagcgtacctgcgccggagtgtcaatcatacgtgatacgacattctgccggtttccatctatattgtcaagtgtcttccattcttcagtctggctgtttctgccttgcaggaagcaagcggaagtaatgtaccctttgtcctcacggcctgcattcaccagtttccaaccgctcacagttttcgcctcacccaaatcaaaatccacatagttcaacgcacttcccacttcacaccatttggtatcgacatccccgtcaacgatgcgttcgggcttctcattatcattaaaatagccggaataggcgataatcttcgcgtccttcaacagattttctttttccacctccacactgttcaactccatctcattgtcacggatggctgtatggaacaagctagtggcaacctggacgggtttcagagtttcctccaccaatgtggcagcaaaaagaacaaccttttcattcttcggaagtataaggctggcagcacctgccggaatatcaacaccgaacttgaacatataggtaaactcataggcctcatcggctgtaggagagtggcggtgagttcccacataagccacttcggcatccttcagataacctttggtatgtcccgaatgtccccactgtccgacaaatccggtataggaaggtacaatgacctcactcttgttccctccgcaccggaaagtggcggcatagtccccgtccgtagcggcagccagaaaatacagtttattatactttttaccttccggtagaacaatagtatcaccattgcacgtcattccgttggcggcatctttctcgccgagctggaaaggaatcccgtttacagtcagggattcgggcaacagttctgccgcaaacgaataacccgactcaaaatcagcttcaccgcggaactcgttgaatgaggaacatttacagttataggacaacggtaaagaggcatattgcaattgataagcgtcctcgcccgatgacttcaaacgtaccttgaatgtctttatagaataaggctttatacttacagacagcccgtttccactgaattcggccgaaccgatactcttttcagtgccatccgcttcgtaggcactggcaatttcgcctgcaaaagaaagtaccgcatcctgcaccttctcaccgcctatctcatagacacgcactacatactcatccgagttctcggctttcttcaatgccttgataatgacattgcggttattggaagagacgaaagagaactccttacccaatgtacccctatgtttatcggtacggaaagctttcagcttctggttcaatatctccgccttctctatggtgacagccttgtcaagtccaccggcatgacccaccagactgtatgtaaagcaatgatgcccgaagtcctggcggttctggtaagcataatccttgtctgtttcgggggtatgcagcagggtcaggcggagggtgttgtcgtccggcttgtcccagccgtatttgctgtcattcaagacagatatgccatagtttccactacggtcagtcaaatcggcccaatactgtgcatagacttcgtaggcagtctccgtattgttgccccgcctcacacttccaagtcccaaatcgtaggtggcttccgtatttgccatgttcaaaggaaattcggccttcaataaagcattggacaactgccagtccacctcattgtaaaagtctatgcggtcggcacggctaccctcatacaaacggatgtactgcttgaagagtgactctccataacgtttctcgatgcagagtgacttgcgcagctcaccatcctccaccagtgtcatcttcacatcctctgtgatggaaaccggttcccggtctatagtctccttcaagatctcccaagcaggccacatgtaggacttgttctgcgtgaagagtgccagacgaatggatttaccgggtttcaccagctccttgccgttcttcttgtcaaacaacgaaacgatatcaccctttgtatccagcgttatcttataaatggaattctccaatgcattggaatccacagatacccgggtgtcagccgacggaccagaagtacggacatcatataccgcataaccggtagcgggcacaatagcctctatcaagagtctggctttaccgtcagcataggacagcaattgggcggccactttccggccattcatatcatatacggtaatccctttcggtttctttggcaaggcaagttccacctctgccatatcggcaacctggaatccaagcgcattgtaaagcaccaccggtatccctttcaccctggtatccatctttcttgccacagcgtcaatggaggaagtaagaataccggagaactgcttgagggaaatcaactcgtcattccatgagaattcataagcccgcggtatacttgttcccgtaaggtcatcatggaactgatggaaaatgaaacgctgccagttctcagtcaatgcagctccgggataggaagcttggttcagccattcggctacaacggaggagcgttccgctgcatcccccaaaagctcattctgacggttgtacagcttcatggcagcctgggaagtataacatccggtaccgtgaacatccatcaacagttcaccgttgaacttgggcagttccggatggcttgcgtaaggctggaagtctttatatatccggtcactcgtggcactgacaatctgcaacggaccattgccttgcaggcctttctctacggcacgtacagactccaatgtaggtgaaccacctatgtctcccgtaccgtaatagcggtagaccatgtgaagcggagagtggccggtcaattccaacaagtccttgttttccgacaggtccccgtcctcaaaacgttggttataatcatatccatgagtcatcatgatggtagagccgtctataccttgccataagccgacagtgaaaggatatttgtcgttgccgtagaacggtttgttgcgccactgcaacttctgggaggagaagccgatcagtccgcaatgggacgcaatggcaggaagtgtccagccaaaaccgaaacagtccggcaagaaaatgtccgtgctctccacaccgaattccttccggtaataatcctggccgagcatgatgttacgaatcgcagactctatggaaggaaccagcgtatcagtggcatcccagctggctccactaatatgccaacgaccgctctctatgaatttcttcatctcttcgtattgcgccggataatattccttcatccaagcatacttgaccgcaccttcaaaattaaagatgtattccggatattgcttcagcagaaacaaattctgactgatcgtgttccatacataatccttgattgtggtctggatatcccagttccactgtgtgtccaaatgtgcatcagacaccatgtaggctttcggtttttgcgcctgagcaccattctgagcataggtaccgccacccattagcaaggcggataccaatactgcaatctgttttttcattttctgtttatttattgtttattgtgtttaaaggttttattcattgtaattcgctgatctcggcgaaaagctcaatcatacaggcattctccagtagacttttgaactgctcttctctgtgacccgaccaatcattactaaacaagccattctcatcacgcgtatagttccaggcataatccgcattctcaatcatggtctttatgtacgcctcattcctatcaaccagatatagtgccttcaagcctctgaacaagattacattaaaccaaggagttcccgggaagaatttcatctctcctattgcaataggctgtaccttcagaaagaaacggcaggaaccctcggctgtctgctgcgcctccttcaggtaacgcttttctccagttgcctgatagagaagtacaccggcctgaatcatctgcccgctgttataagtatatttggccggatccacttttccctgcaaattcttgttgtcccaatatacaaagtcagaagggtcacaaagattgtcacgggtccattgataggtcttcttagcttgctcaaggtattttgcatccttagtcaacttaaacagcttcatacagagaacagtagccggagcattcgaacaagtattttttgattctttcttctgttcgcaccaatagattcctccccccaactcttcggaccatccggaataaatatagtcatgcagctggatggctttttccagatactccttgtcaccagtccgttcatagtaatcacagaaatcaatggccacccagtcattgtcatcgtaataacgatcattatgacctgcaaaagccggatacgactggtaacaatggggaatccgggtagagtcccaataaaggtccagtcccggctttatctgccggtccatcagttttctgtacttcttttgcccggaaaccttatacaaagaaacacaaccggataccaaggctgaataaggccacaaaaaagagacctcctgctggttaacaacagcgccggtattggccgtatatgtaattctctgctccgggtttcttggataagtttccgtcagcaggccatacttctccactttatagagagtaagtatctgctgaagcaaagaatcggctcgttgcagatagatttgtttgcttgtctgtgcagacaagcaaaccggtaacgagagagctattaataaaaataaattcctaagcttcatatccaattcaagtcaagtgattattattccagcttcatatcggcacacatcaggaaagcattgtacggcccccacatggacatgatgaaccaaagctggtcatcattgtctttcaacggatgtatgtaagcgcaatacaaagctggatatctgtccgcttccgccaatactttcggctcgctccactggacgagatccttcgatgtacaataaagaatggcatgccttttggtcaaaggagtctcgtcatgattcggatcataattataagtcagaatccaacgctcaaacttcttgtgccatatcagcgacgcttctcctacgggacctctcaataccggagtagcggcagcctcatttccacgtatccactctttactttcaccattccagtattcataggccttcatatccagaagatctttctcaaggaaacgcgccagatacgcagcatcaccacgtccggcctgtgtgccaagcatataaatccatccgtcacgtttggcataagccacttgcgaaaaatgactgtcgggagaaaaagtcacctcttcacgccgctcccatgtccgaccgtcatcattggaagtatagacagaagaaaaattggtaagccagcgtccatgaggcgctccccaatcatagatgttcataatatggacacaatccgttttaccggcccgaatagcactcgtagggatggaagtctggtatacctccggattcgtcttaccgcccgcacatacctcaagcgccttaccatcggcatcaagcagcattgaatctattttaagaccgtctgtaagctctgtatccgatgaaaaagccagtacgttggaacgccagttggaaccattgccaccatttttattcacgacaaaaccttctccactggtatctccgaaaaacatgcccacacggtttccatccatatgccacattaaccccaaatccgttccatatacatcaaagtcaggtccggtattattgggattcagcaatgtatctcccggcaaaggatcacccgtgacacgggatatcatgcgtacattatcaatacacagcgttttttcactatcagcatccttacaagccatattgcccgtcaaactacaggtaacaagcccgaacagtaaaatttgtttagttctcattcttatcaattccatatacaagtacacattcccacatctattcctttattctttccaggataatcagtcccagttcaaactggtccccaccgttattatttctcacatggaaagtgaccgaattggtttgttccgtcaaattgatgtctcctacatgtactctgtctttagacacttctttgtccttcttagtagagatccatccggacagttgcttctggcgttgccaaacctggaaatcggcaccattcggtttctcgaaatagtttatcagcactttatattttccttcgggcacatcgttcagcatgatgcgcactactcctccatgctgggtggtcatacggattccacgctcatttgttacctggacacctccaccaagactcagctgcatcaattgagggaaataaatatgttctgtcggctgatatacagtgcgtaattcagcagtaggctcttctctgccttgcaatggctgggctgcataaaagaatccaacagatgtataatctaccgggaaattattttttacttcaccatgttccattccatgatagatttccttctcataggacattttgtcggccaagaagaaacggtatccaccggttctggccatcggaagtgaataatccagacaaccatggagagggaggctgtttcctctgtcccaacgatccaataaagcataccagccaccgttataatagtcttcggaaccggtgccgtgcagacgcattttattatctacgtaagtgctgtcgtccccttcgaagaacaaggtcattcccggacgcaggccttgtgcctgatggatggttcctacataatgtccttttcctttttgtgcagcaaacttatggaaaatgccgagaggagttttctctctacgccatacagaatagaacttaccctcttccttcacattacgcttattactgttatagtacactttaacgtttacagaaataggagattgctgaataccttctctctttttataaatcatcttcatagaagctgacttgtcaaaaggcattggcagatagcagtagttggaagtaccttgcttacccattaagatactccgcattgctccttttccataggcatatccaaaaaaatcagcaacgggggcataaatagcctccaccttctcattatcccatttagctgaaagaatcacatctttgtataaaccttcgaaagatgttccgccatcaatcgacatacctacaatacgtcccggttctgccatctcaaagaaagaaacttcttctcccggactcagtgtaaataccttttcttccgtctgtacaccagctgattttccaaaggtataattcgttacagcaggagacaagtcagcccatattctattcacctcagccaacaaatccttatcctgctgtgagaattcaccggtataggtttccaccttctttcccggcaggttacggtattgtatctgaatgaattccaatttaggtccatcgaaaacaattttacaggactttttatacgtaatgggcagataacaataaaaaccaccgatttcattgccacaaacgggctttgtaaacggataaaccttaccggaaaacaaatccgagaactttattttcagaccgggctctttctgtccatcaaaatagaaatagagcatattgtccgtcggtgtaggagtccagattcggttgatgactccggggccttccatctcagcaatcaccaacttatcaccttccttacgaaggaaagaataagtacccgcaaaaccatcatcattgcctccggtacggtcgtaactcgagaactgctccacataagagccagtgcgatactccggcaatttatccactcttttcaataactccagctcatccgtccatctgtatgggttctgagccacggcatacgagcctgccaatagaatggcagacaagaaaacagaaacttctttcaaattaattttcataaactattttactatatgttttttaaaaaggcaaggagagaatgcctgtttaaacggtatctctcctcactgacagtattatttcaatagaaaggattatggtctataaaaccacatcaattctcctcttctgaaagtaccatggtatttacgccaaagaatttggcccattgtacattgttcgggcccggtttcatttcgatataaacaacaccttcgtcattaggctcaatacccttaatctctaccgttctatcgaaattatcgtcattaaccaaataagcaacgccatcgttctttccgattacatggaactcggtttcagttccacggtcattgatgtgaccatagaaactgaacgtatattttgttccttgagagagacctgtcaccttaaatccactgagcggaatagcaataccgtcgctgaaaaacatatcctcagaagctgtttttggaagacccaaattattattcaaaccgcgagccaattctccggaaaacggtttgtccacttcgatgccgaaagtagtaggacgacctctatggtcgagcatatttaccaatccggggtctctgggattccgatagttgttgaacggagccggagaatcaatgactccaaagtcaatataacacgtcttaggagtcttggtaacagtcaagtcactaaagtagcacaacttgccatcggctgtctctaccttgataaccgtttttccaacggcaataggcgtaatgacggctgcgttgttttctacaccttcaatggtcgctacatcggaatcgagcacgctccatttcaacagataggaatcacccgccaaagtgtcaacggaagcggtgacagtgacattctcgtcaatctccacataaactgccgattgatcgatacggacaaacttacgattggacaagtccacctcattatcatccgagcaagacatcaatgtggtaaacgctaacgccatcgtacaaaaaatgaattttattgatttcatacttgttctctaattatttattaatatccgggagcttgtctcaaattgggattgatgtccatctgagcctgtggaacgggccataaatacatccttttgttaaaggtacggctcttgtagtaggttctcttatagaaagccttcggattgttcacatcgtcgctcttctcagaaccgtcatgattcataccatagagcttaccacccaggtgtttgtcggcaatcttccaacgacggaggtcatggaaacggataccttcacaattaaactctacccgacgctcctgctgaatggcagcacgcatctcctccttgctcagcccttccttcaaagcgggaattccagcacgttcacgaatcaagttcacatacttatatacatcgggagtgggagctggcgaagactcgttcaatgcttccgcatagcccaaatacgcttcagccattctgtataagatacccggctgatatacatactttccatctctgggaagtacatccaaagagattcgcttacggacattataaccgttctgcggagagtcgaaagtcatatccgtatcacggcctccttgaaggaagtccacacgacggttatcaactcccagccatgcgccattatagatgacggaaacatagaagcgaggctcccggttgcaatacatgttgtaggtaccttcttctgttaccgggcttacaccggtttctttattggcaaggttcgaaggtccgccgcccggccacttcgtggttctatactctgtattggtagagaatccgttttccacataccccgattccgggttgataatgggcgaaccatcctcgttatatcccaatataggcatttcaccgttcttcatataaaaagcgtccaccagctcctgagtgacacccatagcggcatttccaccgatacctttcggcagatgatgagcctgccagtagttcaggtccacattttcggggcgtccgaaaagaatctccttgttgccttctgagaagcgtttcaacgacatgttgtagtaagacatgaaggggtcgatgcttccatccacattatattcatagtacagcttatgtccggctgcttcggctgcctttatcaagtccagatgagctttggcagccttttcccatctttccggcttggcttcggcatcaaaaaggaattctccttccgaattcttccagtccttgaggtccggatttccgttgaacaacgggcttgcggcaaatagcaacgttttggcacgtattgccaaagccatgatagaggtggccctgccccaatcggtattgttgggatagacagcgggcagatgttctgacacttccagcagctctttgtcaatccaatctaccacttcggcatagggtctttgggaagtcatcatctccgattcgggcgcatcgacggaaacaagcacaccgggagtaaacggtatggcaccatacaactcaatcatcaaagagtaatagtaggctatcaggaagcggacttcgtacttcatctggttgacataagattccgtcaggtctttttccggaagaacttttgcctcttgcaagaagataaggccggaacgtatgcgcttgtgcaattctacccaataataggggtcccatgtagagataggactccagtttccggtggtgtaggcatacacattgccccatccatacggcgaccagtcttggggaatggtgatatcatcgcccatgatgttatagccctgtgccttgaaatacccccacatggggctgggaatagatgaatagacacctgccaaccagtcttcggtccttatcttatccgtgaaaatcatctccatggtaagctggtcatcgggagctttatccaagaaatcgttgcaacttgttgtcaatgccagggtgcacgacaataagacagcttttactatagatttatattttttcattttcttcgtatcttgattaattgttgaaattgatgctaaagcccactgatacagatttcatctgcgggtatctcaatccatcggtagtttccagttcgggatcccaaagcttgaagtcggaaaacgtcagcagattggttcctcttgcaaacaaacggcagccgcggatgccaattttggtagtccaacgttgcggaagggtatatccaagttccagattcttcaagcgcaggaaactcatgtcacgcaaccaccatgtggaagcttgttcattgtttgccacagccttgtctcccatacggggccagaatacatcttgcctcggattttcgggtgtccaacggtcgtcaatattcgaatagatgttaccggcacctaaagaggaacccggtaaccaggtctctccgcccaggagctggtaggttttacctgttccttggaagaatactcccaaatcgaacgacttatagcttactgtagctccaaaaccatagacaatctcaggaatacgtgtaccgccaatggctgttgcatctactgcggtcacttcaccatccccgttcaaatccttgtatttaatgtcaccgggacgcaggttactcatatcactgaatttttgtgcgggaatcccttccttaagcataccgttttcatcgaaatcatcttccgtaaagagcctttcggctatcaagccaaacaattgccctacaggcttaccggtctgcgaacggtatgtacccaagatggcggcaggttcgtctatttccacaaccttattgtgtgcgtaggtatagtttgccatagcggaaatggcccaatcgctattgaacttgtggttgacattcaaagacacatcaaatccctgattatcgaccttgccataattggcccaaacagggcggttgaatccggcagaaccaggcacattcttacgctgcatgaagatgtcatcgcgcttttccttgaacacatccactacgaggttcacgctaccattccatagacctaagtcgataccggcattcatcttggtcacggtttcccatgtcaagttgttcacaccgatttcgccttccgaacgtccaaggcgatagatttccgcatctgtaccccatctgtacgaaccggtattgacaatggtagaaatataggcgaaacgtctgttaccaccaatgttactgttaccggccttaccccaagtagctctcagcttcaagttggagatgacatcggaaaccggctccatgaatttctcggaagatacaatccatcccaacgccacggcggggaagaagccgaagcgcttgcctttggcaaagttctcggagccgttgtaaccgaagttcagctcggcaacatagcggctgtcgtaagtataagagaatcttccggctatgccttgggtacgatagggaagcgcatcaccattgtcatactccttctggttgtagaggaacatggcgttcacatcgtgcactttgccgaaaatgcggttgtacgagaacattccttccagatagatggactgatcgccccatttagctcctttttcatagcccaggaactcttgtccggtggtctgcacatcagtgatgatgttgccctctgcatcgcgtgcggtggcgggattgtagtaataggggttcttggaacgtgtcacggaagttgccgagaacttgtcaaaagagaaggttcccttgaacttcagtcccggtgtgatgaacttcaaatcctgttccaacgatactagggattcaatcttattgtggtttagtttttcgtatccacgctgtgtggcccacgcccaagggttctccttgtgcatcacacggggaatgcgtccatcggcatagatggccggatgcacgtaaggaggtacacgcatggcttgatagaaaatgccctgattggtttccgtgtctcccggaggagcgttacgggtttgcaggaacacgcccacattggcacggaacaaggtagtgggagtcacattcacatctacattggaacgtaccgtatatcggctcaccttcagggaagagtcccactcctggttcttgtcgcgttcaataataccgttctcattgtaatatcctgccaccaacgcatagcgaaggatgtccgtaccaccgttgacgctaacgtttgccttcgtgttgtctgcatggtctttggagatgatgtcccaccaattcacatcgggatagagttccgggtcggtctgattcttgtagttcagcaaggtggcttcgctggcaaagggggctctaccttgctcggcatacatttcgttaatcaattccagatacttcacactgccgatgtaatcgggtatcttgatgggttgcgtaaaggagtgttcgaagcggacgttcacctgcggctttccaatcttaccacgcttggtctcaatcatcactacaccgttggcaccgcgcacaccgtagacggcactagcggcggcatccttcaacacggagaaggaggcgatttcttcaggatcgatgtcgtggagcgaacgctcgacgccgtccaccaataccagcggattagtattgccggtaaagctactgataccacgaatccagaagtcggagttattgaaccaagggtcaccactacgctgaaccgcaatcacaccgggaaccatacccgccaggttgttactgagcgaacggctgggagccgcggcaagcttggcaggctcgatattggtgatggagccgaccacagaagctttcttctgcgttccgaagcccactaccaccacttcatcaagggctgccacgtcttcttccaaagctacatcaagcactcctttggaacctaccgctaccactttgtccttgaagccgatataagagaacctcaatgacggcttattacttttcaacgtaatcgtatacgtaccgttgatgtccgtcaccacaccattggaggggtctgccgcctccgtcacattcacaccgatgagcaactcaccctgtgcatccatcacacgtccggtcaccttcttaggcgactgggcaaatgccgagctactgatgcacaacagtagcatcagcatccagcccacaaattgctttttgggaatattcttcatttcgtacctttattaatgatttattgaatttgctgctccgtagaactattcttccatagtcgtgccattatagtggcacaactttgccaatatagaggcacagtcttgccactatagtggcaagaccccggatataaatatcagcctatgaatgtatagaaaagagcgctaccaaagcttactcgttgccccacagagtggctttgttacccttggacttacgccaagcgtcacgccaacgatgtatgtccatgtgattgatgaaaggcttcggtgctctttgtgctttcgtaggagcttctggaagagcaacggctgaatcttgataccaataggcaacggttgctaaatccaacgtcaaattattattagaaccatgctctatcgttcctttaacactcttctcaaagaagatgggatcagctatgaagaagcggtaaacatgggtacgtcccaaccagccgatgtcattatttacacgaggatacccgaaataaggatgcgagaatgcctctttaggacaccaggaagtattgaaaaaatcttccgtacccgttcctatcaatgaaggtgttttttctccgtcaatgaaccacatatcatccccttcaccataccacatagtagtaggacagtgtacatagtagttaataccaacgaaatgaccttttccttgtgtctctacaaacacgtaattgtccttaccggtagtattcggtttctgctctccggtaagcccccattccgtttcaccttcgggaagggcctccgtgaggttatggttgtaccacgcatggaatctgcccatatctttgggaagcttgtccatttccagataatctacatagaaatagaaggcatcgatattcctgtcactttgattctcgatttcaatacgtgctcccttttcaaaaggcatggtaaagtagcaagacattccggtaccgttttcaggacctgatgaaagaggcaatgatgcataattatatctttcgtcccatccttgcccaaagaaaggtccgataggagactctacagagggataatcgttgccatcccaatacatacggataataatatcatttctgctcaacgcgggaggaggaggcgcaatggttacccaaatatggttgatggcccctgctcccttgatgtctgcaatgatacgtttctcacccggcttgaaaggttccagatgatctctgttgcctccggtagggtctgtactggagattcttttgttctttacacccgatttcaactttgccaagtcaaacatttcattcgtcatgttcgactgtgcaaaaacagcaggaaagtacaatcccagaacaagggagagtaacaaactgaattttgtaattcttctcataaatttttgtttacattgattaattagatgattaatattccaataaatatggtttctcattgaatgttttccacagcaattctccaaacaatgtattggcccatgcaaaccagctccttgtgaatttcttggggtcatccttgtggaatgactcgtgcatgaacccggtaccggcatgcgttttctggagcatctggatacattgctgtaactctttatcgtcttgagcagtcagggctttcattatcaggctcatcggccatatcatgtccgtaccaatatgatgtcctcctatcccttcaaaataagaacctttaaagaaataaggattgtattccgaccacacgaatcttctggtattggcataaattgcatcatcactatcaacaccacccagatagggtaacgccagcagattagggacgttggcatcatcactaagataagccgatccaaagccatctatttcaaaagcatagattttaccgaacttcggatgattcaccacggcataagtctgcaaagcattataaacttctttactcaacgccaacagttcatcagccagtacattgtctttggttatcttttgaaccatttcggaagcctgcctcaaactggccaccgcaaagaaattggacgggacgagaaaaggaaagatagtggcatcatcactaggcctgaaagtagagcaaatcaatccgaccggatttactttatagcccactccacccataggaacagcatctatagcccattccgaagttctgcgaaagctataaggcccgttaccatcttttctctgctgttccttgcagacccttaaaacggtttctatcgccttcttccattgcgcatcgaaaggagaagcatcatttgtctttttccagtatccatatgccaggcgaatgggatagcaaagcgaatccaactcgtatttacgctcatgaatacccggtttcatctccgtatggtcgctgttccatcttgtatacttcgtatcatcatcataaaaggcattggcatacggatccttcaatataaaggaggtctgcttattgataacgccaattatcagtctttgcaggttcttatcttcagacatgaaatccaaatacggatatacttgggcagaactatcccttaaccacatggcatcaatatcaccggtaatcacatatgtatccggtcggccatccttttctgaataaaaaacggttgtgtccaacgtattcggaaaacaattcccaaacagccagcccagttcttcattcttgaccttctgtttaaaagtagcaatggccttttcaatggcaggacttttgaagttcctttccgatataggcttccttactgttggaaacgacgaaaaagaggcagctgtcgaagctacgcctgaattcgcaaacatcaagtttttattcagcgcatatcctgcccccaaaaggcccactctctttataaaatttcttctgttcatgttataaatccattgactaaaaatattatcctggaacaatcttcttatcctaacaaactaacaactgattgaaatacaatttcaactgataaacatcacccttataaccttctgatatgtaatagcgctcctccatcctttgccagattcagttcaatgatatccttccttgtaactttccgtacctgtctgtccagatggtttggattccggtctacatcctctgcatcggtatagatcgttgcttggtagtctccctcactaaggaagtccaattccaatttcagattcctttccgcaccgttgtttagcgagcctacccaccagtccgaaccgctcctgcgggccaccgtgacatgctcattcatctttgccagcggaactcttatctcatcccacgttcccggcacggtacggagcacctcgaaccccggttgaccttcataagcctttggcgtatcgcacaaagaggtgagatggttttccaaaaccacatacatggccaacatatggcagcgtgtgctcattacatgaggatttacatactgtatcttgaactccgagcgcggcagtgccctgaaccctcccaggtgatagtccgtcgctcccgccagcatcctggtgaagggtatcgcaatgtcatggtccgcattcaccagcgtgtcccatttgcatacttcatagttgagtgtcccctcccgtgtgaattcattcggatacgtccttaccagtccggaaggcttgctcgacccatggaactgtatgaagagcctgtgtcttgccgcacattccagtatctcttcttggatgcgtatcatctcttggtcattacggtccatgaagtccaccatgagtccttttactccccatccctcatagagcgcaaaggcttcttcgagtttgtcgtacaacggtctccagtgtacccacagatgtatgccaacccccttgctccttgcatattccacaattctcggcatgttcaggcacggtatcggttttgtaacgtccgcattgggtcccgcccatccgaaattgaagttgtcatcatagtaccaaggagtctccgcatatccgtagattccatgtgcatccaagccattgcgtgctgcaaaatcaatgtagtacttgtttgtatcgaagttgtttcccggagagaacgtgctgtccggcacgacattcccgttccaccatgtgaacgtggtcctgcaaggcttaatccatgaagtgtcttcaatcctgcagggctcgttcaggcttgttagtatattcgtctccagcaatcctcccacccggtctgcaacggagattacgcgccacggggtacggtgcgggaaactgtctgtctcgacctttatcttctcctgccccagttttggcgagagctttcccaccagtccacccttctccttcaccaggtacattcccgcatagtcccttatggccgcttcagttataaccactgccaccccgttgtcgaactcgaatgtcgccggcatctctatcagccttttccttgccaccttgtcatatcttacatgactgtataccccttcgtgtgtattcacatacccgggcaggtacatgagcaacgccatcgggtttccttgcaagttgaactgtgtcctttcatcatacatcacgtatgaatcccatgctttctgttccggaaattcatatctgaatgctatcccgtcatcgaatgcccttacaaccaggtttatcagacggccggaatctgaccgttcctgcatgggaacggtcatttcattgcaacggctacgtacactacttgtcttgccgacaatgagcttgtatgtctcatcaatctttttacgctgcacctttcctgctttaagattccttccgaactctccgctatcaaagctgaaaccaagcaaagaatttgctataagagactgcttcctatagtcgatgtcatatgaaacactctccggcgttactttcagagaaaatctaagttttccgtcaggagacgatacagacattctctgctgtgcagaaacagctataaaacaaaatagtgcaacacacaaaacaagaagtttcttcttctctgtcatcttaatctgtctttgattgtacatccctatcctaattgacctcaatccacaatcttgcctgaaacattatagcgtttcacatcaatgttgccataaaccacgttcaacacaggctttcctgctttccattcaatagttccgaaaccggtatcagtactgatgaaacttttgaaatcaccaatcttagaattgatgtacatggttttgtcaacagcatcataccgcactcctgtaagcccctgcaacattccatagcttgccatggcacgtgcataccaatgcccgcactctatctcattgaatgggtttcttactcttccatcatatctctcacggcattcacggacaatatccaagcccttttccacctcacctttcatcatcaaatgactggcaacctgatattcgataccggtccagacttcattgctgtatacaaaaggcagtgacagcataccacccttcggccatgtgcaaagcaataatccgccatccttaccacaagcatacaccggtctttgaggattgaaatggtctaccaagtcatgtttcagattgtatttgtgtacggccaccagatggctcctgaccttttcattgtccagcacttcatccagtccgcatacggaagccatccacatccctaaaattccatcggacagacaaccggtaccgtattggtattttggcccttcttccttcagcaatttcagggcctcatcggaataacttcccccgaaagacattacatcaaccggattgggagcctgaagcccttcccactgaatcttctgtatgaaatattctccatcgaagagtgcagtttccatatatttcttgccctttgacagcagggccgtatattccttaacgggttgcttcagctccttgcccatctctataaacgcagtcaaagctcccaaatagaaacttgtacacatgccgtccggtccccagaactcgatgtcataagtattgtggtgcggctcttcaagatagcccttatgcaaggggtcccatgtacggatgcaatagtcaagactctttttcactgccgggaaaaggtctttcatccactgtgtatccccgctgatacgccattcacggtaaactttcataatcccgcccaactgtccgtcggcagcagcatggaagttgtgaggtggtgccgaaataggcaagtttactctaaaattctggtgtccttccgtattctggcttaccctgaattccgtttcacgcaaggttctttccaaagacgggaacaaatggggcaaagcctgtgcatagttccacacatgcgtacaacttccgtgacaagagccaaaagaatcctgacatccttcccaagcccaaaatcttccatcccattgacgtaataccgtaggagatttcaatatagttaaattagtagcaacagcctccagtacttctgccggcaaagaggaactatagaatgcatcactgaacagccggctgttcttttccagcatcgcctgatttgcatcccaatagccgataacctcattcaaactcttgaaacgctccgagtaccaaggtctgtaggtagcttcgacatctccttcatctgccaggaattgtttttcttcttcagaagaatccacaacctgccagtctccccaactgttgctttcaaaatcggcaagtaaggtggatgtagaagacaagttgtaaatatcttcattcctattgtctgtcaacacaaactggtcggccagaatatgtccccacgggtaaacatccaaatcaatgactttcacaaaagccttctttccttgataaggtttcaaatcccatacggtttcactcagagtctccgtctgatttccgaccgccgtctctacaatctttccgtctactacaagatttacagaagtacggtcagcctgactgcctccacctaccagaaacttcagatatcttttcccaatattgaactcaggagactgaataatacccgtcagtccatctccacccttatcgaacgagttcagcaactgcttgccgacaaagccgctcacaggttgctgaccggaagccgttcccttgcagggcatccccgtaaatgcctgtcctacctttctggcaccaccgatagaaaggtttgaatcgggcagataccagcagaagtttaccttgactgtttttgtctctcccggctgcaacgtcagcggaacataaacagacgctcccggagcaacacccttaaccggctgcttatcagcgatccgcccatagcgaatattatcccaaaccacagtctgcggatcgaaccaggcaccacggaaccaacaatggtctacaacagcagcagcattgtccacataaatagctagcccactgttgttctgatcggattctaaaacaaacccgttctttactcctcggatagtaccctgaccatcaatgaaatttttggtattataagaaaacacggtttcgatagccttatcggaagtgtttgtaaactgatattccagtactccaaccggtaagctggaattgtccgcatccgtcggaataaaaggactccaacccgtaatctttgccaccaaaggcatatccttgtctcttaaatcaatagtcgcaaaaggaaaacgtgtctggaaaaccgcctcctcaaagcggggaaggccatatgtcttgtctcccctacctaaaccactctgtgcaggaccaaataacttccaagtcggaacctgcccttccaatacctttgctccgttctcaaccccctttacataaatcgcagcaaaggtatacggctcattcatcacatcaggatggtgcctgagagacacatgcgaaatggcaccggttccctccaaacagaacattccggcgccgattccccctataggaaatgcaatcttatccagatattccttttgatacttaccgttaaactcccgcccttcactgttctgggacattgctttacccggaaacagtatagccacattaaatagggccaataaagttaaagttgatcttaccatagctgaattattaatgttaacgaatcattattctatttttccaaatttatcaaggaggcggttgtacgcttcagccgctgctccatttccccaatcatagattgtaaactcacccataccttcacctgccggatttgtacggccgccatgcccgtaattttccattatgaatccataatcctctgaagcaaagaacggatgaactttttcccattgctgtttggtttgaggattttcagtacaatacatcattacaaaagatgccttaagtgcagcatatccccgttctatatactctggcttatcaagaagttttccatattgaatgatgagttcggaaaaaagactttcgcgtgaatcattccattcaccatcggcattcaacacaccaaaaccacccaatacatttacatacatgtatggcggctgccacgatgcttgggtcatcagcaattcatcaagtgtacgctgtccataatcaagatattctttatttgaggtaagacgatagcactccagtaaggcttcagctgtccagaacattgaaaaattattctgtttatgcatattgttccgcaaaacttttttacctaccaagttatccgaaccgtaacgagaacaagaccaataggtttcaaagtcttcccacttcccaaccgggataatttcatggataactgcattcatggctttaaatgctgcccgtttatactcttccttatgtgtaagctcatacagtttaagtaaaaaagtaactgataaagatgtttcaggagaagcattcaaatggttcatcggctgcattgtctttaagtcaagccagccagggaaaaaaccattttcatactgtattccaagtaaagccatcgcataatcttctgcataagccaaaagacgggcatctttttctaattcatcataccaccgaagcatcaacaatgctgtccaactcatatcaagaatatgatacggagattctttcggattccaggtataaggatttctgttggaatttccccaataataggtattccaccccttgctccgattatactttttaccatcaatctctacttcatgcatttccgtaccgataagtccatagaaaaaaccattcctctgcggaaatgacagagccagttcttttgtcaaatttgcttttgcaagaagctccctattaccggttcttcttgcatatcgatataatccacttgcagaacgcaatgaactgaaccatgcctgattccagatagaacgaaattcacgttcattaatctctcccggataattaggactttgagtaacattcacaatgaatacgggagcacccacttttttcccatctaactcaaattgctgccacacattttctgaccatgaattaaaagcccaattataagtatgtttcacatacgtttctaggttttccttcaccggattacctttctcatatgcagcatgcccccatcgactccacataaattctaacggcttcttaaaaggattccgcaatacttccttgctatcagaatacatcaaataaaagcctatttcaatatctccttttgggtaagtagtttcttgatcacgctcaaacagaacgtgttcgaatacatggttattacacattccgagaataagtgtattagaggatgcgtccatatccatataccatcgtacaggagtccccttctgcataatatccaaatcgggaataagaataagagtttgatgatcgtctgctacaataagggcaggagaacggaatacatgttgatcgatgacatttctatcagtaggagtaagatgtggcgcccaatggaacgaaggtaaaaaatccggctttacggctatacgccaatcaccttgttgaacagagtttttaagcgaaaaagaaaggtttatgtacaaagtgttgttatctatcactttcacatggctttttcctctctcaattcctaataaatcatactgtatagcatcaatagctttactaaaatttttcggaaaaacacccttattcaactcaattctctcttgtgcatcccaatgctcttgagcacagatgcctatgttggacattatcatccaaacaaaagttataattaatgtgcgtgtgttcatgatattatatttatcaatataattaaaactctcccatatcagccaattcagccttcattaaaaaaacattataaggcatccacattgacatcgtaaaatataaattatcaccagttaccgacaacggatgaatgtaagaaccatacaattgggcatactctctaccattagcaagctcatagggttcactccatgggccagttatgtcttctgccgtacgcatagttatattatatctatctgcattgaaataagcaattatccatttcttatgtgtctcgttatatataaaagaaagttcaccaaccttatcttctattaatactgttgcctcattttcattgccttttatccattgattagtaaaagcattccaatattcataagctgtcttattctcaatatctgtttcatgaaatcgtgctaatttagcattgctatccctccccgtttgagtacctatcatataaacatatccatctttcttaaagtaccctacctggccaaagaaactataagatgagaaggttatatctttacatttagcccatgtcaaaccattatcaaccgacttatatattcccgaataatttgtaatccatcccgtccaatttctcatattaaaataatgcacataatctattccattagcacgaatagcagctgttgggatagaagtccaatcaccattacctgacgaatcttttcctccatatactatctcgcgggcataccctttatcatcagtagccatattactgaatgacaatccatcttctaaatcattatcttccgagaaagccagcacattactacgccaactccctccgttaggtccaggattagccggattcggtttaaagtcatacccaaaagtatcaccaaagaaaattccatattttccgggctgcatctcccaaataatgccaagatctgttcctcctacattccattttgtcgcagtattattaggacttggaaagttttctccatttattatactccctgtaacgcgagctatacgagtaacattacgaataaaaaaaccccaacggttatccacattcaaagagagttctttcgacatattaccatctttgtaaaaggcagccaatactagccgaaaattctgtggatctgttttttggatggtataattgaaaatataatcagacgtaagttcgctttgacttatcttagctgaatagctgtcacctacactctttctaaccagcaaataatctatggcatcaatatccttaaaattcaatgttgttgatacaatttttgtatccttatttggaatcaaatgagtatccaaaggtataatttcatcaataggaatataagtttcagtttcttgttcagaagtacaagaaacaaataaaaatataaacgaagagaatactataaataatatgtttttcatgtctattgattcatttttcaatttatcgtaaccagataacccattcgccttatatcaaatattaaaatagagagtgagctgactcagaaaaataccagtaaaagcccactctctatcattaactacaaaaatccttctcgaaactattcgacattaactattacaccctcagaagtaacagtagatgtacgccctgtttcttgattttcctcagtaaaagtacctaccaatttaacgatatagcgatacttcttagcaggatcaatagtgaaagtatgagaggtttcctcatttaccaaggttattctatctctataaatattattttccactatttgaatctgtactgaaataggacgtctgaagtcttctggaattactgaaggaatactccaagtcaatgtcactgtagtagcattatcttgaatatactgcacattctcaggcgtaggtatgaaataattcaagcccttgtcatcaagcacatctctgtcatagcagctggacagtgataacactaccaacaacattgtaaaaatggttactatctttttcataattttcttcttaatagttaaacattaatatcccggattctgcgtatagttaccctttgaataattcatttgtggttgggaaatcggaaagtactcatcacgaccggcagtaaaacgagcatcattgaaccaatcgaagcgagttctttcaatagcaaaatattcgttcattgtcttttccaacaatccccaacgctgcaaatcaaagaaacgatgaccttcgcaagcaaattcaagacgattttcccacattaaggctttccatgcaaagtccttagtccaattacagttaatacccggctgataagtagcaatatgataattcattgtatatgaaccgtcagcttgagtcaaacgaaccaaactattggcagcacgagtacgaatctggttaatatatggcagggcttccatttctctatccaattgaatcaaaatctcagctttccacagcaacacgtcatcgtaacgaatcatcttcttattcatagaattaaattgccatccatcataagcaatacaaccacaatcaggatgtggcatatctttgatgggtttcaagaaactataagtaatcggatcacgagtagcagttgaatggaataataaatcaggatcatacttccaaggctgtccaggagctacgatagtatggctaaatcggggatcccatgtatacttatcaaagtaaggcttagcgccagaattaacgatatccaaattataagaaccatctgaatttttaatatattgaccataatcatcctcattataatcctcgaaacggggtaaaccgttttcatctgtcttaaacgcattagtcaacgtatagctagcatggttaaagtcacaacacttaaatacaaaattaccaggttgtgtttcgggccacatccatggatgattcaaaccttcagcgcgattaaatcgacctgctgtatgaaaattattatcaagagcaaattgtaattcccaaatggattctttagtagcattatcatactctaccaaaaagttattaccaaaatcagattccaaacctacacgaccaccttcttgatcaataattttatcaatataaggcaaagcttctgcaagtaattccttattgatatttatcacttgatgacggtcatcctgttcgtaagccatatttaatattgtcctagcaaccatagcagtagcagcattacggcttacacgacctttatccatctgatccaaaggcaataattcctcggcctttttaaaatcatcaagaatacgttgccataagtaaagatcattccccttatccaattcacggttaggtactgcttcaaaagcatctgacatacctactacattctcatcaatatagggtacatatttccaaagttttttcaaacgatacaacgtaaatgaacggataaagagcatctcacccataaaactattcttattaggtaactcttcttccgtaaaatttgccattctttgaattgctgtattacatctttggataacttgataagaattataccaagtaccatccaatgcaccggtattaggatttacataagtaaaaagtgatatgttaccaaaagaacctacagcatcagcaacaccaccaccacctttgtagcagtcatccgaacgcatagaaccactccaccaatacatataaggagaggaatccaatgaccccatctcacacatacgggcataggctgctgtgacaaaaccttctatatcgctaggtttgttaagtatattttggtccagaacttgtttaggattgatatccaaatatgaatcacaactgctgactcccaatatagagcatagagcaattgataaagttatatatttgcttttcataataatttattaattaagtttaaaaagaaacattgataccgaaattgaaagtaaatggtgtcagataatgataagaaggtctttctggatcgaaacttgtatatttgtcatctccccaaaacttcttcaaagtaaatacattatatgcagcagcatacaaacgcagattactcatatgcatttttttgataagcttagtcggaaatgtataacccaattcaatatttctcaacttaatatatgaaccatcttctatgaaccaagaagagaatctttgttcttgattggcagtattattcgagatagccggaatatcagaattcggattgtcaggtgaccaaccgcccaacatacgagttgcatgatttttccatgcaggattggtgaaaagccaaatatcactctctttcttccagtcgctatttacatcattaccgaacataccctcaaaaaataagttcaagtcaaagcccttataagcgaaatcaaaattaagacctccaaagaaatccgggtcatagcaacctatccaagttctatcatatgtttcattgattacaccatcaccatctaagtccttgtagcgaatacgtccaactgctttacctggctggtctgcatgagcatcaacttcctcttgagttttgaaaataccatcagctaccaaaccataagcagaatttggagaacgtcctaaaatcaaatcgtgtacaccatcaccagcatacttattgattacattggaaggaaggtcagtcaattcagttttgtatgtaccaatattggcactaacagcccactggaattcactggaggggtcactcttgaaagatactgtaaattctacaccttggttattcatactagcaccattaacccaaggttcaccaccttcacccattgctgcgatatatggagtctggaccaagatatcatttgttttcttatagtaatagtcaaaagaaccagtcaaacgttgattgaaaaatccaaagtcaacgccgaagtctgtttgtttggttgtttcccatttcaaatcagggttaccaatccaagttcttctatagccagactgcaaagcgccggttgcttgtcccttaataggatatgcagtatcaaaataattagtagtaaatggagtagttgtgtaaccacgaggtaatccttgtacactaccattcgtaccccaactgaaacgaattttcagatcagacaaccagtccgcatcttccataaaagcttcatccttaattctccaaccagcagaaaatgcaggaaatacaccataacgattattgacaccaaacaaagaagaaccatcacgacgtacagttgcagacaacaaatatttaccagcatatgaataattggccttagcaaaaagagagaaataagtatattcatcagcagaactacttacatcaatttcatcaccggtagcaacactaagaccggcaaaatcacgatcttccaaataaagtccttctctacttgcataaaaaccttcttgtacataacgggtaaactcactaccaaatacagcatcaatatggtgttttccaaaacttttattataggacaaagtattagtccatacataatttaacggatgggactggttatttcttacataatttttatcattgcctctaaaaccagtctctacataagccccatctactgttctactataagagttaccataatttataccaaactgagttctagcagatataccattccaaatattcaggtctgcaaaaacattaccaataattttcacataattattgatattatctttacccatagtcattttacgtaccggattatcaaaatcatcaagtcctgcaggtcctgcccagttaccatttacatcataaacaggaaccataggtggcataatcatagccaaaaaggtttcccattgacttttatactgcaaataagaaatagctaaattttctcctactttcaaacgatctttaatcaaactatattccgtgttagcacgtacagaatattgtttgaaaaaagaatgaatttgtgtaccttggttgttagtataccctaatgaaaacaaacttttagctttatccgaaccattagaaatagtcaactgatgatttgtagaaactgctgtacgaaaaatctcatccatccaatttgtatcagttgcttttaccaattgattattatccaaatattctttcattttcatattatccaataccagcattccattatcacctctatgatactcatactcaaagccattgggtaataataggcctgaaccataagcccactcatcataagcagcagcgcggaaggcagcagtaccccattctgtggcgttcatcatttccggtctatttattatagaacttacagaaacactaccattatagtcaatggtagtcttaccagctttaccttttttagtttggactaaaatcacaccaccagaagcacgtgcaccataaattgaggcagaagcagcatctttcaatacctgaatagattcaatatctcctgaatttatgtcacgtagattcagaccttcagctggcataccatccaatacaattaatggagtaacagctccagacaaagaagaaagaccacgaatttgaatgcctatatcttctgcaggattaccgccattgttgctaattttcacaccggccatcttaccctgcatagctttcataacgttagcggaagtcttcttgatgtcttttgaatccgccaatgcaaccgatccggttaagtcagcttttttctgagtcatataaccagtgtatacaacgacttcagacaacatcgtagcatcacttttcataataacatccaaagatttcaagcctttaacagaatattcttctgttttttgaccaatataagaaaagactaacacagcattatcagaaggtattcttatcgaatattttccctccacatcagtagttgtacctatagtagttcctttaacgacaacatttaccccaataagaggttcattagtcccttcttccagaactgttccttgtattactctcgcttgttgaatctcattagaagtatctacgccatgctcagatacttgaatagatccatttgtccccgatgcagcggttgcaaggggcaaattatcccctgcatacactgcaaatgatagcattgatgccaatgctatgaaaccattccttttaaaagaaatcctcataatactttgatttaatagttaataaaaaaacaacgtaattttaaatatcgggtatacccaattttaccatcttggaatttccaaatcgtccttgctcggcaaagccgggaatttggcatgcggctcggcctggtaccagaaagtggtcgacgagatatccgacttctggttgttgtagcgtccgtcatggcgccatcccaggtcctgtatcgtgaccttcaggtccttgtcgaagcgtaccgggtcaaggatatgccagcggtacagcccgaaagcggtcaccgcacggtacagcccgtcgggacggattacctggtgcatgccggcataaggggtggtgaactcctggtactggcgcgtcttctggttctcgaaattgtacgaaccgcagaagtagtcctcagtcccggtcccgcagatagtcggatattccctgtcaccgtccatgtagaacttgatttccccctcaccccaccagcagttgtcgtttacacgccacgccaggtaggtacccacgtactgtcccttgcccttcacaccgtcaatcagcgtgtgcagcgacccctgggtcgggttggagcggcggaactgcgcgtggaagtaggcctcgtcctcaggaacttctgtcagggtgtagttgatttggtagtacaggcgcatctcctcggcggtgttgatgttctccagcgtgatacgggctttcttgcggaaaggcatcttccagtagcagttgaaggcgctgcccggattcacgcagacggccagtgaggagagctgtgcatattcattgtatgcgctgcagaagaagtcacccaccggacattcgacggaaggctccttctcgtcgtcccagtacattctcaggatggagaagcgccagttcccggtcggtgtcatccagatctgctggatggctcccggaccctcgatctccgcaatcgtgattgtctctcccggtttcacgatgatgaaggggtttaccttccaacccttgcccaggtccttggccgcatggtgggcgttggccacattgcgctgatccttgtccctgaccggatcggccatgccgcccttgcccttctcgcctgtaaagttctcagggctgatggaacgtgtcttggcatcggacagtcttgacaggttacccatgttcatgtccagaccgttgaacgggtagttgctttgggcgtaaacacccacggtgaccatgcataaggccgccaaaattaatgatttgattctcatgttttaaatagattaatggtttgtatacttagttaatggtttcagcaagttttgccagttcaagatatttcttgtatagtttttcgtagatgagggctcttttctcatccggccggtattcagcctcgatgtccgaccccatgtgccttgtcgcctcattgatatccttgtacacccctgcggcaactgccgcgaacattgccgctcccaaggcacaggtctgttccgagcgtaccacacggatgggcatgtccagcacgtccgccagcgtctgcatcacgaagggcgccttcttgctgatacccccgatggcattgaccgaatcaatgcgcagcccctggcccttcatatgctccacaatacggcgggaaccgaaggcggtggcttccaccagcgcacggaatatttccggggcgctggtacccagcgtgagtcccgcaacggcacccttcacgttctggtccgcatcgggggtacggcggccgttcatccagtccagggcgacaacaccgtcctcggagggttccatgtcctgggcctcacgggtgagttccaccagcatgccgtccagaactttctgcctggcctcccctccggggatatctttcagtgtccatgccagcatcttcctgaaccaggcgtagatgtctccgaaagccgactgtccggcttcgaaaccgacgaatcccggaagcaccgaaccgtccacctggccgcagattcccttgatacagcgtccgcctacctcgtctttgccggcaaccatgatgtcgcaggtggatgttcccatgatacgtgtcagtatccccggggcgacggatgcgcctacggctcccatatgggcgtccagcgcccccacggccacggcgattcctcggggaagtccaagcctgtctgcccactcgggtgtcagttcccctgccttggtgtcgctggtgtgggtttctgtgaacagatgggggagcatttccttcaaggccggattaagttcttcgagaacttcgccggaaggaagaccccaactggcatgccacattgctttatgtccagcagcacaacggctacgaaaaatctgttccggaatagtgttaccagttactaatccagtcatccaatcacagtgttctacccaagcataagcagcatcctttatagcgacgtttgtgttgataatatgtaaaacctttgaccatacccattctgatgaataagtaccaccttcataaagtaaataatcaaggttacgtttattaatcagtgcgttgatttgctcagcttctcgaacagctgtatgatctttccaaagaataaacatagcatccggttcttctgcaaactcgggacataaagctaatggcattcctgccctatcagttaaagcaggagtactaccagttgtgtcaaaacataatccacaaatagaagcaatctcttcttccttcaaatcagataaggctatatgtacagcctctgtcatggattcaatataatccaatggatgttggcgatagcgattgttgtgtgcatcgcagtaaagccccgctttccaacgggggtaaaaacttacccccgtagccatttcacggccagtatatgtatccactaccagtgcacgacaagaatccgtaccaaaatcaagaccaataacgtatttcttgtttgattccatagtctaaagcattatttggttgttaactcttgttttcttgcaatgaaaaacccataataggcaatcactgcaaaagcaacggccggtacagcatatgcagccataatactacctgtctggtcggagacaataccctgaatttgggtcagaacggcagcaccggcaatagccattaccatgaatgaaccgccgattttagtatcatcccccaaacctgtaagaccaaaaccataaatggtcgggaacatcaatgacatacatccggaaatacccatcaggcaatagacgccgaaactgcccttaccgaacatggcacccaaacaacacattacagcaagaagcgcaagtcctatcaagagtttataagctttcacgtacttcatcattgcagtgcatacaaacctcatggtcacaaagagaatgagcgacatgatatagtaagtggccgcagcctgttctgccgtacgcggcagcaagtcatccaatccaagccattcacaacaattatagaatgcggcagctaccggttccactccccgtaatgcatttacaacagcatctgcagaagcagaatctcctaaagaagccaatacaccgtcaaaattcagctgtaccatagcataacggatcacgaatgaccatacggctatctgtgcaccaatattgaaaaattgtgctattacaccccatacataattcttattctttataagacgacgaagagtggcaccaaactctattttttcacctttttcactaagattaggcattttggtaagccgaatagcaagtaagagcaccaacatcaccagaccaagtaccacataagcagtagtaacagcattcaattcctgcccctggatggcggccagctcctcagccggaagttgggcacgctctgtcgctgtcattccattcagttgtgagaggatgaaaatctgactgatcaccactcccgtaatcgctccgaacggattgaaggcctgagacagattcaaacggcgtgtcgcggtactttcaggaccgattgccaatacataagaattagtagacgtctccagaactgaaagtccggcaaagagaacaaagattgccagcagatacataaagaagctgaagtcaacattcactcccgagctaagcatggcaggatagaacagtaaagccccaaatgcatatagaccaagccccagcatcacgcctgatttataagtgtatttcttgataaacaaggcaccgggaacagcacaacatccatatcccaacaaatagcacactacctgtatccaagctgtttttgaatcactcatactcatgatgcgcttgaaagctgcaagcatagtatctgtcagattattcggcacagcccaggcaaagaaaagagtagtgagcagaatgaatgggaagaggattcctttcggtattattttatttgattccatacgaattctccattatatagttaccctattgaaactttgtttttattacattcaaatctgctccaaataaatcttgcacgataggaaccaattgttcatccttaccttgtatatgaatcaccttttgcgtatggaccaatgaggcaccgggagccagctccgcaccaggagaagacgtttcaatttcatagaaaggtcccattatagaaccgtcttctaccggaccgtcattataagagttgattacatcgccagcaaacggatcttcctgaggtccccattggccatttacgtagactgaaggagtttcgggaagactacaccacaggattgtgagtacgcctttcgatgaatcataacttccgcaaatatccgttgcccgtgaagccggcaatcccagcttggaacgatagagcccgtcaatcttgaaatagataataccattttcctttatcagcctatccgccggtatcttaccgaaatattcatcattcacaattgttccttccgcatcttgcttataaggaatgaatacagtagtggtcggtgtaggattaaaacagccgagcatccacacagatacaagaccaccctcttttgtccatgccttgtcacctgtattggtaatcttattctcactcttgtaagctacaattttcatatcatttgtaagctggatattaaaatcggcagccacttcaccagcatccatcaacgatacagtacggtcaatattcatatcaaaagtagtaccggaagcatttgtcaaacgagtatctttcacaaaacggatactactgttgtcttgcgactttatgtcaaaagcttcagtatcaagtaccggaggaactatccaattatcataaacctgctcttgtccttccttaaaataaagtgagaacggaccaccttccggaccaagccagaagcgttcctcacctcctaccggattaaattgagaactgactttgccttcatttatgaaacgataattaatccagccgtaactatcaccttcatcgccggaagcagaagtagtcattacacggccttgccatgcaggaataaccatcactttagaattcccatcagcagataccaattcagtatattcaatgccgtggtcctttaagaactgggcatcataagcataacttcccatcttgatttctttttgtccgccgcatgatacaagtattgcagttgcacctaccagcagagtgtttttcagtttggttgatttcaacataacgcctgtttcctttatttatagagaggtccataattcttgcaagctctatagtcactgccttccatatcctcgccaaaagcggtccatgcactgggacggaaaatattttcctcagaaacattgtgcatgcataccgggatacgaagcatggaagccagagtaatcaagtcagcaccgatatgaccataactgatagcgccatgattagccccccagttattcataacagtatatacatcacggaaataccccttacctgtcagacgtggagcgaagaaagtggaaggccatgtacggtcagtacgttcattgatagccttgaaaacatccttatccaaatttactgtccagccttcggcaatctgcaataccggaccttgaccttttacgagattcaaacggcacattgttaccggcatttcaccacgagtcaggaactgggaagaataaccaccgccacgcatatattcgcgactggccggatgccacttggttacagaaagacaagcttctacttcctcttccgtaatttcccagaaaggcttcattaccggtttattgtcacgtgtctgacagcctgttccatcaagcgtacaagagccggagttgatcaggtgaatgaaaccgtttgccgccttaccttccaatttcttacccgttacccgttctatggcattcggactccaataagtacgcacatccgcaaatatctgtgcagtattggtcaatagatgattgaagagcattgaagtacaattcaacgtatcattttccgtagcgaaagtaaatgcttcacggataccgttccaatcgaaagaagtattcagtatagcttctgaaaaatcaccgtcaggcttataatccgtccactggcgctgtccctggaaacccgcagcaatcgcattgtgtcccattgactcttccttgaaccccatttcagccaatttgggattgccaatcatcatatcacggaaaataagagtcatttttaccacgtattcccaacgggcatctttctcttcacgggaatataccagatgttccggattaaagtctgtcccttcattactcttgcaatacttttctgtccatgccatggcacgtgcgaactcttcatggtcataaatgcccaactggacacgacgttctatctcactggcatccacatactcattacgcatgcccaaatactcttggaagaaatcaggattgggaatagagcctgcaatgcccatggatacactgccgattgaaagataggatttccccttcattgtagccacagctatacctgcacgggcaaaacgcaacaatttttcctgtacatcttccggtatctccatattggtcacctcctgtacatcacgtccgtaaatgccaaaagtaggcaatcccttctgtgtatggcttgccaatgctgaagccaggtaaaccgcacccggacgttctgtaccattaaagccccagatggcttttggcatttctccgtccatatcaatagtttcgaatccataacaccagcaaggagttacagaaagtacaacaccgactccactattacggaatttttcagccgccatggcagcttcagccactccaccaatagttgtatctgcaatgacgcactctacggaagtgccgtcactatgacgtaagacagaagaataaagctcggccactttatgggccatggccatagtcatatcctccaatgactcacggatacctccacgacgaccgtcaataataggtctgataccaattttcggctttccaccgattaatcttgaatttctcatggttcaactgattttattgagattaatataaaaattaactaaatcgattaagctatcatgtaaaaaaaacagctctcctaaggagccatttcaataaattctccctcggcaagcacagactgcactgtattaccgttaataatgatatctatcagtatttcaagtgctttctgtactaaaacatctataggctgctgaatataggatataggggcatcaaaaaagtcaaataccggattaccgtcaaaacccactaaacctattttaccaataattccctctcccatgtcctttattgtatataaacaagccaatgaaatcatgttggtggcaaaaagaaaagcgtctacaccgccatcaatcattttaggcaacaaacggtctgcggactttctgggagcatcctgcctcaaaaagaccacgttagccaagtttctcttaccggcttcatccatagcctttttataaccacggatacgctctttcatatggataaggttgacatcataagccaccatacaaggagcgttatagcctgcattcaaaagatgtttggttgatatataggaagcattgaagttattcaacgccacatagctgacattgatttccggaaaatagcggtcgaacaaaacaatagggatattattgttcacaagtgaagcgatggatttctcagaattgtcacaaggaacaatgatgagtccatctacccctttattaataaggttactaacaacacgggtcatcttatccttatcctcatctgaacttccaaaaagtacggtatatccccgtttggttgcctcatcttccaatacacgcgctaattgagaaaaaaatgggttggaaatatcagaaaccactaatcctattgtttttgttttgccactacgaagacttttggccgcaagattaggctggtagttcatttcattggcaattttcaatatgcgttgggcagtttcttctcccacgcgatactctttctttttcccattcaaaacgaacgaaaccaatgctgttgaaacgcctgcagcttcagcaatatccttcagcgatattttttttagtgacgacatatatttgtgtaacgtttttgctatataatagtattatacttttaggttacctcttgaatcagtagcacttatcgtattctcacgatgcaaatataaacataaaaattaaatctgcaaattatcttgctaattcgttataacatttttatatttgcagtaccaaatcatgctaaaaacgatatgaactaccataaacgacacataaaaattaattttaaacttttaaaatcatgaaaaccaagattctatttacacttttattctttgcatgcagaatacactacctttatggacagactaacctacaaatagctccggaaactttagcaactccggaaaaaaatggaatatggttacaacctgctcaaaatacaaaagcacaacccatttggggatttgcaaatggtatccgaataggaattgctccattaggaggtccacgtgggctaattcgtatctatacaccttatttagaacatgatgaatttgttgttaccaatttcattgcttttgaaccaattgataaagcaaaaaataatagggggctctcagaattggaatggagtcaacttgataatgttcgtggaaaacgtttttggagtgggaatactcctgaagctccctcattcccaaatcaatattatccagctcacggagtaatagcaaaggaaaatggagttgaaacacttactgtgtatttcttttgtgaaacttttgataatggtgcggatatctatgtccggactaaattcacagaaggaaagccttatgagtttgaattaactacgtataccacggaagagtcagatgagctaaatcgttttatactcacagctactatgggaaacaaagcaagacttaggacattacatctcgcagatggtaaaacgaaagaagccggccaattatggccgagctataaagattctaatttcacagaacataaccatactccagtggcagaaatgataaaagataaaaatggaggtgtatggtttatagcgtcacctgatgagaaagaccctacaaaagctgtatatgctgaagatacacatacacattggaaatatactggtaaaaaagcaacgcaatattggtattgttccaatccaagtaatgagttagaaggagttgtgaatggtcgttatacttattgggcaagtaaatctccgatacctggtggtatcgcttatgagaactttgaactgactgaaccatttcagtctggtcaaagctatatttttggtatcacacctctttcatcggaagaattaataaaccacattatgaaataagaacggactactttttgggtagaacttcttttcctccttatttatcccctcttttgttcttaatttatagaacagaaaaggataaaaggtggataaaaataagaaaaggataaattacaaaacttactaaatagcttattactctaatgagaacagcagaaaatagatactctatttctactgttctcattttttatatatatacaacttttcatagtataaaatctcaaaacaatcttttaaagtcaacttaagagatacttcttaactattgttggggtcttccttccggcgaagttctcaaagcatttcacttgctggaaccagttgctatctttgatgtttggccaactctcgaatcgtgagagtctgagagatttgattgtcgctcttgatgctcatcattctaaatgttatcatctggggatgggcagaaatgtttcaagatcatccttggctagagccaacggggacagggactatcacatctttgaggcgtatgcttactacttggtaaacgaagcaagacaaaagcgtgttaccgacatcttcaaactcggtggaaacgtttacgcctttgattcaacaaccattgatttatgcctctccgtattctggtgggctaaattccgtaagaagaagggtggtatcaaagtgcatacattatatgatgtggaaacgcagatacctgcatcctttcacattatcgaagcttccgtgcatgattcaaaggcgatgaatgaaattccctatgaatctggctcctattatatctttgaccgtgcttacaacaacttcaagatgttgtatcggattcatcagataggtgcttacttcgttgtcagagccaagaaaaatcttcaatacatgcctatcaagtggaagcacaggttacctaaaaacgtattttcagatatgactattggattgacgggcttttatcccaaacaatactatcccgaacctcttcgcttggttagatattgggatgaagaacaaaaacgtgagtttgtttttttaacgaatgcaacacacatttctgcccttcaagttgctgaactttacaaaaaacgatgacaagtggaactgtttttcaaatggctgaagcagcacctcaaaatcaaaaagttttgaggtactaccgagaatgccgttcggatacaaatctacgctgctatatgcacctactgcctggtcgcaattgttcaacacgacatgcaactggataggagcacgtacgaaattcttcaaatattgagcatctagttgacagataaaacgcctcttcgagacctctttgacaaaactaaattgcaaaatgacaaagaacgatttggaccaaatggaccaagtttatttgatttttaataacgtcccaattttaatgggacactaatgttcaattgccatttataaaaaatctgcgatttacaagaatttcaaaggactattctattcatcacctttttcccgcccaataaactccccccaatatcagcaccgcccccatcagagcaaccatcgtcagccgttctcccaacagaaaagcagaacctatcagcgtgaagagaggattcagataaatatagttggaagctcttattgttcctaattgtttcaatattacattccagactacaaagcaaatcaaggaagccaatacacccaggaaaagtaaattgaacagaatagccggctcgagaagacgggcaatgtcgaaattccagggatgaatcagaaatgcaggaagaatagtcaatactccataaaaaaatatcttacgggtaatgaaagttataccataacaattggacatttttctcattatcaagctatagaatgcccaggaaaaagcagcaagcaaagtaaggaaatcacctaaaggagaaattttcaatacaaagctaccgttgtaaaccaccaatgccacaccaaccaatgccagcaaagaaccagccatcaatccacgggtagccttttcctttttataaacccacaaagaaagaatggtggtgagtaacggagccgtacagacaataaacgacacattcgtcgccaatgtaatctccaaagctgtattttctgtaaaaaagtagaatgaaccgcctgtcatgcctcctaaaaacatccaaaattcatctttccaattgtcggcaaacagttttcggggagaaataagccaaatgcccatataagctatcaggaaacgaagcaagaatatttcctgcggagaaagaccgtgcccaatcaatactttcgttgaaataaaggtcagcccccaaatacctaccgtaaggacggcaacaagatgataagtataatttttcattgcgttcatacacttccgacaagtcgcacaaatatacgtactttcttttttcaatacaatgaaaccaaccataaataatgttcagggaggatttactaaaactcgaaggaagatttactaaaacgggaggaaagatttagtaaatcttccttcgagttttagtaaatctttaaaccccttattagaagcctattgaacgaactctcatttatcggcagaataataaacaacaatctgccgaatacacagacaaaaaacacaaaggatgaaatcttcccagacttcatccttcgctatatcctaaaaatcttttagtaaatatcctattgaattaatttagctattatttgtattacaaacaaaaaattagttttaaaagcacatcacaaatgtaagtaataaaaagtgaattatcaagtctttgccattgttttttatgttacttcgctacaaatctgaaaataaacccgtaactttgcaccgatattaaccgaatactaaccggttttaaccattgaataaacaatgttttcaacaaaatattaataagtaccactatggaatacaatttcagggaaattgaaaagaaatggcagaaaaggtgggtggaaaacaaaacctaccaagtgacggaagacgaaacgaagaaaaaattctatgtactgaacatgttcccctacccctccggtgcgggattgcatgtaggtcatccgctgggatatattgcttcggatatttacgcccgctacaaacgactgcaaggtttcaatgtactgaatcccatgggatatgacgcttacggacttccagcagaacaatatgccatacaaacgggacagcaccctgcaattacgaccgtcaacaatatcaaccgataccgtgaacagttggataagataggtttctctttcgactggaaccgcgaaatccgtacctgcgaaccggaatattaccattggacccaatgggcattccaaaagatgttcaacagctactactgcaacgatgaaaagcaggcacgtcccatccaggaactgattgaagcattcagccaaaccggtaccgaaggaataaacgtggcttgcagcgaagaactgagtttcaccgccgcagagtggaatgccaagagcgaaaaggaacaacaggaaatcctgatgaactaccgtatagcctatctgggcgagacgatggtaaactggtgccctcagctgggaaccgtacttgccaacgatgaagtggtggacggcgtaagcgaacgaggcggcttccccgtcattcaaaagaagatgcgtcaatggtgtctccgtgtatctgcctatgcacaacgcttgctggacggactcgataccatcgactggaccgaatccctgaaagaaacccaaaagaactggataggacgcagcgaaggcgctgaaatagaattcaaggtaaaagacagcgatttggaattcactatcttcaccacccgtgcagataccatgttcggcgtcaccttcatggtattggctcccgaaagcgaactggtacagcaacttaccaccgacacacagaaagatgaagtaaacgcttatctggaacgcaccaagaaacgtactgaacgcgaacgtattgccgaccgtagcgttaccggtgtattctccggaagctatgccatcaatccctttaccggtgaggcagttcccatctggataagcgactatgtacttgccggatacggtacgggtgccatcatggctgtgcctgcgcacgacagccgtgactatgcttttgccaagcacttcggtctcgaaatccgtccgttggtagaaggctgcgatgtaagcgaagagagcttcgatgccaaggaaggcattgtatgcaactctccacgcgaaggcgttactccctattgcgacctctcactgaacgggctgaccatcaaggaagcgattgccgctaccaagaaatatgtgaaagagcataacttgggacgtgtaaaggtgaacttccgtctgcgcgatgccatcttctcacgccagcgctattggggcgagccgttcccggtttactacaaggacaacatgccttacatgattgacgagagcgccctacccttagaactgcccgaagtagccaaattcctgcctaccgaaaccggtgaacctccattgggacatgccacaaaatgggcttgggatactgtgaacaaatgtgttgtggaaaacgaaaagatagacaacatcaccgtcttcccgttggaactcaacacgatgcccggatttgccggttcaagcgcctattatctgcgctacatggacccgcacaacaaccaggcacttgtagataagaaagtagatgaatactggcacaatgtagacctttacgtaggcggtaccgaacatgccaccggtcacttgatatactcccgtttctggaataagttcctgtacgacctcggcatttccgtagccgaagaaccgttccaaaagctggtgaaccaaggtatgattcaaggacggagcaacttcgtctatcgtttttctccttggaataagactataaaagaacctatagcaactaatatcttcatatcaaaagatattgtagatagaatgttatcaaatgaaggaataccaccttatgaattaaaagaaatatttgataaaaataatatcaaatatgaacagaattggctaatttatcaaggtattaatcttaattgtaatgaaattcacgttgatgttaatattgtatcaaatgatattttagacgaaaaatccttcaaaaattggagaccagaataccaagatgctcagtttgtacataacgaagacggcaagtacatctgcggatgggctgtagagaagatgagcaaatccatgttcaacgtggtcaatcccgacatgattgtcgacaaatacggtgccgacactctccgcatgtacgaaatgttcctcggcccggtagaacaatcaaagccgtgggatacaaacggaatagacggtgtgcaccgcttcatcaagaagttctggtcactgttctacgaccgcaacgacaattatctggtaacggatgaacctgccaccaaggaagaactgaaatccctccataaactgattaagaaagtgacgggagacatcgagcaattctcttacaacacaagtatcagtgcctttatgatttgtgtaaacgagttgttcggaatgaagtgcagcaagaaggaaatcctgaaccagtttatcatcgttctggctccctttgctccgcatgtatgcgaagagttgtgggagacactgggcaatgcaggctccgtatgcgatgccaagtggccggtatgcaacgaagaatacctggtggaagatacggtcaactatacggtttccttcaacggaaaagcacggttcaacatggagttcccggcagatgcggcatcggatgccatccagactgctgtattggccgacgaacgttctgaaaaatggatggaaggcaagtccatcgtcaaagtaatcgtagtgccgaagaagattgtgaacatcgttgtcaaataacagatatgcaaattacaaaaccaaccaaagcggaagtgacgagagagctgaaggattatatcttcatcactctgggactcatcagctatgcactgggatgggcggcattcctcattccctatcagattacgaccggaggtactaccggtatcggtgccatcatctattatgccaccggatttcccatccagtggtcatacttcatcatcaatgccgtactgatgacttttgccatcaagatactcggaccgaagttcagtatcaagactacgtttgccatcttcggactcactttcttcttatggttttttcagttgctggtgaacggttcggacggcgtccctccccaactgctgggcgaaggacaagacttcatggcttgcctgataggtgcggcaatgtgcggtgccggactgggtatcgtgttcaactgcaacggcagcacgggaggtacggacatcattgcagccatcatccataaatacaaggatgtcacgctgggacgcatgattatggcttgcgacttcattatcatcagttcctgctatgtggtattccatgactggcgacgcgtgatattcggttttgtaactttgtttgtcatcggatttgtactggattacatagtcaacagtgcccggcaatccgttcaattctttattttctccaaagaatatgaaaagattgccgaccgcatcaccaaagaaacccatcgcggtgtaacggtactcgacggtatcggctggtacagtaaacacaacgtgaaggtactggtcgtccttgcctacaaacgccaatcggtagaaatattccggatggtgaaagatatagacccgaacgctttcatttcccaaagttccgtcatcggtgtatacggagaaggtttcgaccggttgaaagtgaaatagggacttgtataagccacaagtataaggagaacataatatgagaaagaaatttgtatttgccaccaacaattcacacaaactggaagaagtgactgccattttgggagagaaggtcgaacttctcagcatgaaggatatcaaatgcgatactgacattccggaaactgcagacacacttgaaggaaatgctttgctgaaagcaagatatatcttcgataactatcatctggattgttttgccgatgataccggtttggaagtggaggcccttggtggggcaccgggtgtatattccgcccgttatgccggcgatgcacacaattcggaagcaaacatgaagaagttactgaaagatatggagggcatcgagaaccggaaagcgcaattccgtaccgtatttgtacttatcatcgacggaaaggaacatctgtttgagggcatcgtgaaaggagaaattacaaaaaacagaaaaggcgcttcaggtttcggttatgaccccatattcattcccgaaggatatacgcagacttttgcagaaatggggaatgaactgaagaataaaatcagtcaccgggcattggccactaacaagttgtgtaagttcttaatgagataatgtttttaatgtgctgatatgctaatgtgccaatgtgctaattggctgcgctgtcacgccgaaaggtcattggcacattggcatatcagcacattataaccccagttgagccgatatttccaacatcctcttaatcggtttcactgctttttctgcaatctcagcatccacctttatttccggtgattcgtttttcaaacaatcataaagcttttccagtgtattcagtcgcatgtaactgcattcattgcaggcacaagtgctgtcgttgggaggagccggaataaatgttgtctgcgggcattgtttctgcatctcgtgcaggataccgctttcggtagctacaatgtagctcttttcgggatgtgccactgcgtacttcagcaaagctgccgtagagcctaccacatcagccagtttcaagactgtactcttgcattcgggatgtgccagtaccaccgcatcgggatgctgccgttttatttcaacaatcttttcaaccgagaattcctcgtgtacatggcatgcgccatcccataataacatatttcttccggtaatggagttgatataattacccaagttccggtccgggccaaagattattttctcatctttggggaagctttccacaatctgctttgcattggtagaagttaccaccacatcggtcaccgcctttacggcagccgttgtgttcacataggatatcaccgtatatccgggatgctctttgacaaactgactgaatttgtctgccggacaactgtctgccaacgaacagcctgccgccatatcgggcaccagtaccttcttgtcgggacaaagcaccttcgccgtttctcccatgaagtgcacaccgcacatcacgatgatgtctgcctccgtccgggccgcccattgcgccaaagccagactgtcgcccacgtaatcggctatatcttgtatttcacctttctggtagtagtgtcccagaatgattgcgttcttctccttcttcagctgcttgatagcttctataagattatccataattatattttttaatttctctttcttctttaaaaatcctttgatagtaatgataggctgttaacagtgtggacaaataaatacgatttttcttgcctatgaagttattagtatcaagctgaattttactcttatgcttataaaccggggtttttaagtttatccgttgataataagacttctgctaaacagcattaacatgttgttaataatatgcaaagttaataactttagagttataaaccgatgaaaccaggctgaaaaatatgttgaatgaagcctggaaaattctccttaacttttttggtttgttcgtttcactgctgtaatatacagacctttgaataatgcaaggattatttttaaaattgtttccctattgtattgacaccttttcaacggttattaaccgggatataaacggaaaaaagtatctttgcagggagatttaaaagtatattgtcatgcgtaaactgaagataactgaactgaatcgtattagtgtagaggaatttaaggaagccgaaaaactgcctttggtagtggtattggataatatccgcagtctccataatataggttccgttttccgtacttcggatgctttccgcatcgagtgcatttatctttgtggcattacagctaccccaccccatccggagatgcacaaaacagctttgggagcggaatttaccgtagattggaaatatgttgataactctgttgaagctgttgataacctaaaatccgagggatacatcgtttattctgtagagcaggcagaaggtagtgtgatgctggacgaactggtgctggacaagactaaaaagtatgctgtggtaatgggaaatgaagtgaagggtgttcaacaagaagtgattgaccattcgcacggttgcattgaaattcctcaatacggcacaaagcattcgttgaatgtatcggttacggcgggtattgttatttgggatttattcaagaaactgagataataacagggctgttaataagctgtcaatatatcgggtttgttggagctatagatcgaacacggtgcatctatagatccaataaactagttctatataggtatgatgagagattttatgaacagtggttgattataaaaatcaaccactttattcattgtaaattaatgctttatctcttactttatcctttttgttaaccatgtattcaacacatatcggttgtatgtggaaaacttgctgtacagttggtgtcttttcttattttttgtatatttgctgaatatatataaatcatatcgatatgaaaaagataatatcttcatggataggcatttttgtaggttgtactattctggcagcaggttttgtttactttatcaatccttataatcttgttcctggcggggtgtatggagccagtattgtgcttcataatctgttcccttctattcaagtaggtactttcggttatatgtttgatattcctttgcttatcatttccgtgctggtactgggagcaaaattgggagcacgtactatcgtggcagcactgttcactccgcttgccatgaatgtgctgtctctcctctcctatccttctgaagaagcgctccatcagttggaccctacacagttgttgggtggcagtctgaatatgtccgaccatttgatgctgacttctgtgattggtgcggtggttatcggtataggctgtggtattgtagtgcgtagccgggctactacaggaggtacggatattgtagcgatgatattgcagaaatattgccatatacgtttttcaaaggcgatactgctggtagatggtattgtggtgggattcggcctattggttatcggtttcggtatcggaaatccggatgatgctacacaaccttcgtggcatttgtctttctattcactgatagctatttttgtcacttcgagggtattggcctatgtgataaatggggagaagaatgacaagatactgtttgtcatcagtgatatgcgccttaccgctttgcacgactatattcttaaagatttggaccgtacagccacttgcatcaagagtagtggtctttataccaatgtagacaaggaaatgctgtttcttgtggtgagttacaaggaagtggtaggtatcaagcagaagataagggaagtagacccaaaggcttttgtagtggttaccgatgcttatgatgcatttggtgaaggttggaaagagcttccgatggcaggagaggtacaacccgaataggtagtaataaacaattgttcattctattattaactgaatatatagcttaatatcaattgtttaataactaattatttgtgttgctaacatagttttcaacatggtgttaacgataagttttttgtttgaatgaacggtattgttgcgaagtcgatgatgtggaacttatggcatggttgccataaattgagtgcaggttgcaagcattgttatgtttatcgtggtgatgcccggcgagaggtggacagttcggtggtggtgcggacaaaaaactttgacctgcctttgcgtaaaaaacgtaacggagaattcaagataccatctggaacatttgtctacacctgctttacttccgatttctttgtggaagatgctgacaaatggcgggccgaagcatgggagatgattcgttgtcgcagtgacctgcattttatgatgattaccaagcgtatagaccgtttttctgactgtctgcccgatgattggggagacggatatgataatgtaaccatctgctgtacggttgaaaaccaggcttgcgccgattatcgcttgcccatctataggagagctcccataaagcataagataataatctgtgaaccgctgctggaaaggatagatttaagtacttatgctgttggcgaatggattgaacagatagttgcagggggagaatccggttacgaagcccgcccttgtgattttgaatgggtgatggaccttcgcagaatttgtgtggaaaataaagtggacttctggttcaagcagaccggttctaagttcgtcaaagacggaaagacatataatgtgaaacgccaatttcaacattcgcaggcacgcaaggcgggaataaacatcagtttataattgtccgctttctaccatcaatatcactcgttcggtcaatgcatcgtctcccatagggtcgtattgtttttttagactggcgccgaagagtgcggcaaaagtctggtagaaaccggctttgaaagggcccataaaagcttttaccagttcatatccggtggagttggtctgtcggtctaccagttttattaacagtttgccttgggcaaaggtaagtttcttcatgcggggagtgtattgctccttcaagcttttctctactgctttcatgtgtttctggcgggctttctcggtgggcagggtcatcatgtattcgtaggtttcaatgatggcacggttaatctccttggagatgggaagtaccttctttacgtcacgaatgagtttgtagtacttgttcatgtcgcgcttgttcttgaatttaagcggcttgaagatgtagacagtggggagcttgacataagggatggtatctccttcgtaaacgcacatgggagtaagatagacactcttttgcgcagcagactgtggttgctgctgtgcaaaacatttcaggcttccgagagaaagaaacatgatgagtattactatgttaagccttgcgttcatgttgcaaaagtacaccattctgtgtaatgttgttgcatcatgttgatttttccttgctcaattaacttatttaaggtaacttcgcttcccaaaacatgaaagtgacctactattaatggaattactcaagataggagtttttgtaagtatgctgtcaatgactcctatgcttgaagctcaaaatatatccggccttcagaaagaacagcctttacttcttttggaagaaaatttggaacaactttccatcgggaatgaggaagaatacggttgggaagatgaattggaggagttgtcccgacgtctgcaagagcctgtcaacctcaatgccgccactaaacggcaattggagcagtttccttttcttacggatatacagatagagaatcttctggcttatgtctatatacacggacagatgcagaccatttatgaattgcaactggtggaggagatggataaacgtaccatcgacctactgctgccctttgtctgtgtgcgggcagtgaaagcgggtagggggtatcctgctttaaaatctatactgaaatacgggaaacacgaaacattggcacgtttggatgtaccgttctatatccgtaaaggatatgagaagaattacctgggaccttccctttaccattctttgcgctataattttcattatggagattatctccaaataggcgtgacgggagagaaggatgccggagaacccttctttgccctgcacaacagaaaaggctatgattactattctttctattttctgataaagaatctggggcggctgaaggctttggcattgggcaattaccgtctgagcttcgggcagggactggtacttagtacggattttcgtttaggaaaaacattctctatgtctacaacagaatatcgtaccggaggcatccgtaagcatagttctaccgatgagtacaattatttccggggagtggcggcaacggtgggagtattgccttacttggatatttcggctttctattcgcatcgctccatggacggtgtggtggaggatggcgagataacttccatttacaagacgggattgcatcgcacgcagaaggaggcagataaaatgaatgcctttgccttgcaggtgataggtggaaacatgacctatgaaaagaactctctgaaggtgggagtgacggggatttactattttttcaaccatccttacaagcctcggttgaacaagtatgcaaagtacaatcttcatggaagtgatttctataatgtgggcatggattataggtatcgtctgggccgttttgtctgggtgggggaagcggcaaccggcagtaaaggctatgcgttgctgaaccggctgaagtataatctttcttccgattatcatctgctacttgttcaccggtattattcatatgattattggactttgtttgggcgttcctttggcgaaagcagtatgccgcagaatgagaacggatggtatctggcagcagaggccacacctttcgcccggtggaagtttttcacttcactggatgtgttttcttttccttggtggaaataccgtataagtaagccctcaaagggagtggatgtcatgtttcaggttacttatactcctcgaaagagcctttcgatgtattttaattatcggtacaaacagaaagaaagagacgtgacgggtacaagcggtgcagttatcgaacctatttatcaccataaactccgttatcggctgacctatatgccgggaagatatatctttcgtactacaatagattataaccacttccgtcagcaggatgggaaagggtatcgctttgatagacggcaaggttatcagtgtactcaactttgctcgtacactttccccttccctctgtcagtttccgtgcagggaacctggtttcatacggacgattacgattcgcgtgtttacgcctccgagcgtggattgttatatactttctataccccttccttctatggcaaagggttccgttactccgctcatctgcgatatgatttgagtaagaacttcatgtttcttgccaaattcggacagacggtttatcaggatagggagacgattggttcgggcaatgatgagataccgggaaataggaaagcggacttgcagatgcaactgcgtatcaagttttagaggaatgattgatagcttttttatttctttctttatctttgtccgtatgataatccaaggatgaactctggagtgctaagattagtagatactcggagtattaaatagtaaatagtaaatcgtcaaatagtaaatagtatgactgtcatttatccatcccccatattcggtcccgttcattcccgccgtctgggagtatctttgggaataaatttattgccggcagacggcaaagtatgcaccttcgactgtatttactgtgaatgtggtttcaatgccgaccatcgtcccaaacagccgttgcctacgcgcgaagaagtccgttcggcccttgaagcccgtctgcgggacatgcagcaaaacggacctacaccggatgtactgacttttgccggtaatggagaaccgacggcacatccccgtttccctgaaatcatagaagatacacttgccttgcgcgacaagtattttccgaatgcaaaggtgagcgtactgagcaattctacctttattcatcgtcctgccgtattcgaggctttgaacaagattgacaacaacatccttaaactggatacggtggatgaagagtatatccgtgtacttgaccgtcctaccggacattactccatccgggagattatagaagggatgaaagcgttcaaagggaactgcattatccagaccatgtttctcaaaggaagttataaaggacaagatatggataatacatccgataaatttgttcttccctggctggaagctgtcaaggagattgctccccgccaagtgatgatttataccatcgaccgcgaaacgcccgaccatgatttgcagaaggccacccgcgaggaactggatcgcattgcggaacggatacgggaaacgggtatatcggtaagtgtttcttattaataatatacttatgaaatcaatagcaattaaagatttaagcgagaacttcttcgaagtgataggcaaagagtggatgctggttacggcaggcagtaaagaacatttcaacaccatgactgccagttggggaggtattggctggctttggaacaagccggtggtgtttgtctttattcgttccgagcgctatacgtatgagtttatggaggagaacgaatatttcaccctttcttttttaggaaaggaaaaccggagcatttacaacctttgtggcagtaaatcgggtagggaagtggataagataaaggaaactggtctgaatcctatcgttaccgagcggggaaacattctctttgagcaggaccgcctgggattggagtgccgcaagcttttcattaccgatatgaaagaagaactctttctcgaccattccgtctacgagcgttggtatggcggtgaccacggtggattgcaccgggtttatgtagccgagattgtagatgcctgggtaaaggaatagctcctttaccacagtttcaagtcatattcggcttccaccttctcttctatttcatccggaagggcggggaagaagtcgatacctgtaatacgttccacttcgtccactgtattgacgtagctgtccaacggatgattgcctgatgcattcttataaatgaagccgatggctttggggggattgctgtctgcacacagaacgaccttgaagaatgcttcgggcactgtaattttgtgcttcttaccaatggtgcggtgacgttggtcatagagaataggaccgcatacaatgtatatcttgccttcttcttgtgcccaacggcggcatgactcttccagttctttccagtcgccacggtttagattgtggttctgcgggcaaatgtttgtcgtgtagaagctctcttgcatggctttccagtgccagcggttgtcaccggccggacacatatgtccgcggtccatgccggctcctttgtagtcatcggtggttactgcctcgtgctcaggcaggtcggggtcgggcaggaacttgtctgtacggctttcacgctccaccagtttttcgggagtgagttcccaggctacccagttgggtatctttaaatctttgttgtaggatactgtgtagcctttccgctggagaatctgttcggagacgttcttcagctttgccggtatttcaaggcgtgtgcctgccgtgagttctattttggcaggcgtagaactcttttgcctggcatccgaaagtatctttgcaacgggttcataggcaaggcagaccgcacatataaacaatataagataatagacgccttgcgattgtttctttttttttcgtgccatgccgggattagtgttggataatcattttggccctttccagtgccacatttatgttcggacagatattttcttcgcccaacagctcatagaagcccgatttttccagtaccttatgtaccttttcattgacaccggagagcacaatggttattttttccttttgggacatctcacaaaggcttgtcaagttgtggataccggtagaatcgatgaacggaactttacgcatgcggatgatgcgcactttggggcggtcgcccagccgcgccatgatttcttcgaatttggtggcgatgccgaagaagtaaggaccgtttatttcatatacttccacatcctcggggattatcaggtgctcgtcattgcttgcaatgtccgattctgcattcgggtctatttcatctttgatgacggatatttcggtagtctccatgacgcggcgcataaacagcacgcaggcaatcaccagacctacttcaatggcaatagtcaggtcgaagatgacggtcaggaagaaagtaatcagcagtaccgtgacatccgatttaggattcttcaataatgccttgaacgtacgccaaccactcatgttataggatactatgaccagtacacccgccaggcaagccattgggatatactgtgccagcggcatgaggaacagtaggataagcagcaataccactgcatgcaccatgcctgctacgggagtttttcctccgttgttgatgtttgccatggtacgcgcgatggctccggtggcagggataccgccaaacagcggggtagccatgttggcaacaccttgtgctatcagttccgtgttggaatcgtgtttgtcgcctatcacaccatcggccacggtggcagacagcaaagattcgatggcacccagtacagcgattgtaatggctacggggaacaagttctttatcgcttcccaatccagggcaggcatcacggcatccggcagttcggcacggatgctgaaacggtcgccgatggtatcgatacaatcaatgcctccatatactttcatcagccagactgccactgtcaccacgatgatggcaataagtgaccccggaatcttcttcgagaaccgcggtgtaatggcaatgatgaagatgctgacaatacttacaatcgtgttccaccagtttacggtatcgaaatgtcggaaataaatcatccattttcctacaaagtctcccggaactttctctcctccgaacgtcagcccgaaaatgtcggcaatctgcgtagtgaagatggtgacggcaataccgcttgtaaaacctacgatgatgggataggggataaacttaatgacagctcccagcttgaacactcccagcaggatgagcagtacgcctgccatcagtgtggcgacaataagccccgattcaccgtattgctggatgatgccatagataatgacgatgaacgcaccggtcggtcctccaatctgtaccttgctcccacccatcagggagatgatgaaaccggctatgatagccgtaatgatacctttctccggtgatacgccggaggcgataccgaatgcaatggcaagcgggagggcaacgatacctacaatgatacctgccatcaggtctgccatgaacagttctttagagtaattttttaaagccgtgtatagctttggtctgaatccgaacgctttcattataatctacttttttatacgtttttttatacagaatgtaatgtatatattgcaaattgcctgcaaaagtagataaaataatggatattagtgaacacaactgtgatgtattttgttttccttatcagatatgtgctattaattatgtctgaaatacctcttcgggttatcggtgaagatagattctttctataagacgataaataaatccgatggggaagaggtgtgattattccaaattaaattcgtaattttgtgttgtttataaacagtacgaacgacatttatacgtaattatattaactaataaaaaaagagactatggctaaaagtgttaaaggaactcagactgagaagaatctgctgacttcattcgctggtgaatcacaagcaagaatgcgttacacttattttgcaagtgtagccaagaaagaaggttacgaacaaatcgccgctattttcacagaaacggctgaccaggaaaaggaacacgctaaacgtatgttcaagtggctggaaggcggtatggtggaaatcaccgcttcttatcctgcaggtgttatcggcactaccctggaaaatcttcaggaagctgctgccggcgaacacgaagaatggtcattggattatcctaagtttgctgatattgcagacgaagaaggtttccccgaaatcgctcttatgtaccgtaacatcgccattgccgaaaagggacacgaagaacgttatcgcgcttttatccagaatatagagactgccagcgtatttgccaaggaaggcgaagtagtatggcagtgccgcaactgtggtttcatctacaccggtaaggaagctcctcaggtatgcccggcttgcttgcatccgcaggcttatttcgaagtaaagaagtcaaactattgatgataatttcctcatagagagaacaaagtcccgcagagcgaaagcaagctctgcggggctttttgtttgctgtgacagtcatatagcttgtaattgctgcacatttgctgcagcgtcactgcaaacaaattgcagtgcgactgcaaaactgttgcagtgctgctgcaaatcaattgcagtactgctgcaaaccggtatgcagtgacgctgcaaaaagtatgcagtcgttttgcagtggctgtacagtacgacagcaagctgtgtatggcgatgctgcagcgggcagagaaggattaatagccggttgttggagatgtagggggattaatggttgcttggaacactattgaaagtgcttcataactgttggcagcatcggttatttcaagcagtttctcccagttggctaccggttccgtcttgtggttgatgcgtttttcggcttttattcttaatgttccgtcttcagtggtggcttggacaatgaaagcgccgcagtcgttttctacttttacgttcagtctttccaggccttcgggagaaattcgataaccttccggcagattgactgtgatgtcccattggtaacaacggggcatctcccaataaatgtcctccttgcgcaggcgttgttcgcctttcagctctggctgtgaccctatcaaccgacctacggagagaacaaagtttgtacccgctttctttacgtatccgtccagtacatagtccacttgataggcaagtgccgcactgtctgcccggtttccgatgctgaaaagctggtagccgaggagtgtttccagtccttcttccgagccatgataaccgatgatttcattacggtaacgctctttctcctgctcccgttcacggcggtaactttcgcgcaggtcggcatggaatttttctttggtttcgtcgtagatggtggctgtaatacccagttggcgacgaacggagttgtaaaggtcctcgtccataatgaggtagggttggaagtgttctttcagagcaccgctcatctcttcccggcggctgatgtggagagtggtgccgcttatagaagcgtttatggtagccatatcccggttgtcttggggggtggtggagggaagggtaaggcatgtgttgtcttccagtatggcttcttcgccttgcaggctggcaggcacttcaccgggaacagcatagcaggccggtggagtatagcattttccgttggattccagatagataaaccaagtggtattgctgtagttgatgagctggtccagaggctcccgagtatctttggtcgtgattcctgtccggtggggaatacctgctttttccagaagttcgtgcatcagcaggatgaaactggcgggagtatagtctgcaccgttttccatataccggtaatagcagtattggtagaggtagtccatcagtttcttatcgctccatccttcggcttgacgggctttgagggctttggatatttcgcctttccgtccgctgcgcagaccggaccagttggtgccgggagccttcatggaggcacgtgtgtcatctgtcatcagttttggattggggttggcatatagtcccggcttgcgggcgctgggtggcatccaggcatagggtgtcttgctgttgtagatgtacatcagaatcatgggcgtttgccgggcactgttgtaccagaagtcgggaatgacacgtccggagtctccggtatgcaagtcgaggatatggtttccttcggtatcggtgctatggtcgaagtcccttgctccgttcaggcaacggtagaaagtgctcagcttcgggtctatctcgcaatggacggaataggcaagcagaggatagctgtccataaagtaaaaaccgaaaggttcgggattctggttgttcagtatggtgtatcgtacgaagaacaagtcgatgatgtctccgatttccagtccgggtacggccagcttgttccatttctcttggatgttgcggctacgtgggtggccgccttcatcggtttccatgtactcctgcgggtctgtttcctgaattgttccgtccggtttgatgatgcgcacacccagtatacgctgttgttcattacgggtgtagcgttctttttcctgggaaaggaagctgaactgtgacatctcttccagtgcactttggctgttgatgtataccatttggcggtagatgctgcggcaggttatctgttgtttggtcaatcccattccccaccagtccaacttggttttccgggttacctccagacggctgtgtacggcaaggataacggcgggttcgtttctgtatttctcgggtacagtcatatttttaaagtcgggcaggttcagcgaccatacttcattgcgcacttcgcttacgagcgcagcatatttgtcttcttccttttgggcattcagtcccgaagtggcaagtaacatcagcagcagtaggaaaaaacgtgttgttttcatggtgatggcgttttatgttcaattatttgtttaaagggtgctttgccggattactatctgttcgttgcaggcttttttccattgtcgcagggcattattccaagcagggataagagcaagtggaatacgttttctgcgtatctccatcacttttcggaagtggatatatcctgctccggcgcggtaggagcaactgaggatgccctgattcgtttcaatgtgaaagtctgcaggcaaataagacacggcatatccttgtggaatatcaattgttacctcgcgtataatacggcatctccacggcagtaggtaatcctgcttgcggcgggtggtgtcaatgggctggtggaagaaatcttcgtgcgggtctgcttcgaggcagtactctccatcggccgattgtacggcagcggtattgtttatctgattgtttagcaggtctgtctgcttctccttgggggtgtcatggtagagactgagcaggtattccttgtattcgcccgtacttacgcggatggcggtgcctttcagggtagggggattgctgtccgtcatcaagcgatagtgataattgagactgtccgtagaggtagaggcatcctgctggggaagagtcagtatcaggcagcagtctccgttttctaccagtgcttttcggccttgtataccttgggggatgtcttcgggcggtaggtatcggtaggtggcatccaggcaatatcttttcccttgatggaaaagaaggcagaaggcatggttgatggcagccagtgtcggcacttcgtcgggagaactggcgatgtcgtccgtaccgatataggccattcgggcatcgaatccttgggctttcagcaatgtgcgcagcaggagtgccattcccttgcagtcgccgtaacgcttgcgcagcacttcggcaggccggtcgggccgatgtcctgccaatccgttttcaaaggcgatgtagcgtatgttctgctgtacgtaggcataggtgcggcgtatcttctccagttcatcggtgcatccggcagtaatttcatccgtcagcatttcggcttgggggagagtgcagtccacctcggccagtccgttcagccagcggtacatggcctgtacatcggcaaagggaccggtcaccagcagatggggatagaggcagttgtctgcgggagcagcttcttcctttcgggtggcaggcactccttttaaggtgtagacaaaaagggaatccccttccttattcacgctcttttcataccggatgccgggaccgaagttcttctccaccagccggaaacgggacagtgcggcaggaatggtgacggtgatacgtttcttgcggatgaagtattcctccggaaagtagatgtgtgtaaagtagcgcaggtcatggaaggtacggttgaactgtacggccgcctttttcccctgccggcttagggagaggttgaagtagcagatacgggtatcgtcgaagaatacattttccggtgtggcatggcggtggatggctttgggggcaagtactcccttggctttggcttcgtccagggagatgaattcgccatagaacatatgaggttgtacggtagctcccatccgcaaggcttcatattcggtctttcgggtgttttgtacgatggggttgtttcccgggccttctttaaaaacatagctgtcttcacagcagttgatgatgatattgtcgtccatcgtctgactgtagagacagcttgagaaaatatacaaaaaaatgaaagagaaatattgtttcctcatgatggagaggatttatgtttatttcttggcgtgcggatagtctatcgtgtagtgcagtccgcggctttccttgcgttccatggcttgctttgttatcaggtatcctacgtttatcatgttgcgcagttcgcacagctctcgggtagccttgctccgcttgaagagtgcttctgtctcctcgtaaagtatgtccagtcggttccaggcacgtgtcaaccgggtattgctgcggacaatgcctacgtatgcctccataatttggttcacttccttcatgctttgtgtgatgaggacacgttcttcggtggaaatggtaccttcgtcgttccattcgggaatgtcttcgttgaagtcataacgttccagtacgctcagcgcgtgtttggctgccgcgtcggcataaaccacggcttcaatcagtgagttgcttgccagacggttgccaccatgcagtccggtgcacgaacattcgccgatggcgtacaggcggcggatgctgctctgtccgtccaaatccaccttgatgccaccgcagagataatgggcggcgggggctaccggtatgtattcctttgtaatgtctataccgatgctgaggcatttcttgtatatgttagggaagtgcttcttggtttcttcggggtctttgtgggtgacgtccagatacacatggtcctcaccgcgctgtttcatttcgttgtcgatggcacgcgccacgatgtcacgcggggccagtgagagtcgcgggtcgtacttctgcatgaattcttttccgtctttggtacgcagcacgccgccataaccgcgcatggcttcggtgatgaggaacgaggggcggtctcccggatggaaaagggctgtgggatggaactggatgaattccatgtctttcactgctcccttggcacggtagaccatggcaatgccgtctcccgtggccaccagcgggttggtggtatggcggtaaacggcttcgcaaccgcccgttgccatgatggtgactttggaaaggaaggtatccacctcgcccgtcgcttcgttcagcacataggcaccgtagcacttgatgccgggggtgtggcgggtaacgatgattccctggtgatgctgggtaatgatttccacagcgtaatggtcggtcagtacggtgatgttggggtgttgcttcacagcttcaatgaggctggtctgtatctctgcacccgtattgtccttatggtggaggatgcggaattcggagtggccgccttctttgtgcaggtcaaactctccgtcctcctttttgtcgaagttcactccccatttgataagctccttgatttgttcgggggcattgcgcaccaccttctctacggcttcacggtcgcttatccagtcacccgcaatcatggtatcttcgatatgcttttcaaaattgtctacggccagattggtgacagaggcgatacctccttgtgcaaaataagtgtttgcctcttccaaacctgccttacaaatgagggctactgttcctttatgcgctactttcagcgcaaaactcataccggcaagtccggagccgataacgagaaaatcgaactttcttaccataggttttgtgtattaaacgccgcaaagatagtgtaaaccaaacgtagagcaaaataagcgggcttatttttatttgttatgtaaggtattgtttcaatacttcatccagggatttttctttgggcaattccatgttcttgcgcatgcgcgaacggactacgtttacactattccggttgattcccatgataagggctatttcgtcggtactttggttcatgcagatgagcatggccagcaattcttcgttgcgggtcagttgaggataactttcgcggagcttgggcagataagaaggatgtatggtggcaaacgaccggcggaatgtgttctcatcttccctgctgagcaggctttgcacggtgagctggcgaatggagttgaggttattggtagccatggcccgttctatttcttccgtcagttgttcgttgcggcggttcaggtcttgctgccgggtaatgagggtctgtatttcccgtttgttgttttctataagctggtggttggccttccttcggatgatgaaataggctgtagtggtgataagtagcaacagtaatgtaatggagatgcagatgttgtagaacaactgctgttgctgccattgcacttgtgccgagagcagtttgttttctttctctttttggttggcatcaaaccggatgttggctgctgccacagcacgtttcttttcgttattgtccagagaatcggcaaactgtcggttacggatgtagcaacgagcaaaatcgttgttcatgcctttggccagatagtaatccattaatatctcgttggcatcgcggccttccatgaacttcatgttgatgaggtcttgtgcagcccggtctatcaggtgtatgccgttttgctccttcccggtttgcagtaaggcccggcctaggtggaggttgagttggtatttggcccattggggcatccgcacggtatcgggacagatgctaagggcaagttgcagtgctttttccaaagagtcgggatagtccagataactgtttaccgtttctactttgtttacgaatacgcccttaaagctgttttgtatcattgacaacttttctcccagcctgaggtagtggaatacagagtccttttgattcatgttacgaaagatctgggcacggtagcggtacaagtctcccagtccgaagctgtctttcagcatggagtagtattgggcttttttgttcatttccagggcctggtcgtacatacccagttcggcgtagagattagcttgttctccgtaggcaatcactacatttccaggtgctatgctgtcgttgtaagtggctatggcttcttggttagtggctatagctttctcgtattcgccactgaggtggtaatagatgcccaaccgtgacattatccgcagcatgttcgggaagtttccacctttccggtagacatctattgctttttccaaaatttggatagctttgggtagattgtttccggagtacatgtagacaccgcttatgatttctgcctgccggataaagtcattggcactggtacagaccggtaactggaggtagtcttctgccagtcggacagcttccgggttattgccatacagttggttcagtccggccttgaagctcagcagttcgtgcgggcaatgttcgcggatgaggggatggttcccaatgctgtccatatagtcgatgccgtctttgtattgtttggtgtttatgtaattgttcccgcaggcattaaatatcttgcgggcatagtaaatcagggtatctgtagttccgtttttttctgccgattccaggatttcgggcaaggtctgtttggcaagatccaacgtttgtcgcgctttgttttcgagtagtaaggcattgatttgttgaaggacattgttccaatgcctcatttcgtcttgttccgaagaggtggagcggttggtgcaggctacagctacgagaatcagaagtaaaaatgaaagttttttggcattcatattttgtggactgtttgttttgtaaggcaaagatataatttcttaatttaaaatttacaacaatggacttgttttttgtttcttgttaattatttgataataaatataatatgaaattgtatatcagattgtatatcgtattcttatggttaggttgtgcatattttgcaaatttgtatcaaaacgattgtaaatatgtataatggtgaaataagatacaatgaaaacaaagaaaacagtgacaccttttaatatgcaggagattgccagagctttgcgcgaaatgatttcggaagattctcccaatgcttcggaggctttgttgtccggaactcgtgaggctgtattccgtgaaatctttatttttcattatccttcttttttagagaaactttatcagtctattccggaggtggataaggatgaagaactgatatgtatgctggtagctcttggacagtctgtaaaggagattgcagaactgatttatttttcgccggaacgggtagaattgttatgtgcttcggtctgccgcaagctgaatgtgacggaagttcgagaaatggagatactaatgaagaagttgttatcataaaaatacgtaccttagcggcaaaaatcagataaaatgaatcgaatctttcatgcgcgcattgctatggggcagtatctgtttctcatcctgataggtattctcgccgtctatatgctttggtacaagtctccgttcctggctgctattttcatgctttggctggtggttattatcgagaagctgattcataccacctataccgtaacgcccgacgggaagttggtgctgtccttcggccgtttctcccggagtaaggaaattctgatgaaagacatcacttctgtggagcgtgcttcttccatgcaggtagggcggtttgcggtgatgcgctatgtgctcgtgaaatatggcgagggcaagtgtgcagtgcttcttcccgtcaaggaggaggagtttatccggttactggaggaacggagagggtgagcaatagggtgtgcccacgtatgcgattccgttttaatctgccgttatcggttccatggtaatgtctcctgtgtagctttccggagttgtttgtatgaactttccctttatctgtttttccgtttttgtatattcacctgcgaatgtcagcgtataggtagctacaagcttgctgtagtgtagtgttccttttatgatgagccgacagtgaggttgtatgctgatggtggaagtactgctgtttggacctttggcttttgttgtttcgctgccatattttatggttgccccacttaacaatagttcatctccaaacatgtaaggggtattgacgaacacatcttcttcccccatccatacaaatgcttcggggtcgttgctctgaaaggtggtttcctgccatgtgtcttcgaagggggagtttgtggtggtgatactattgtttaaattgttttccatgatgaagggcaggagctctacatcatacgtactgaatccatccccttcttcaaaagagtattgaatatctttgaacagatatttttcagcatctttaatttcgtctttatcataacagccggtcgtgcagacaatcagcatggcggacaatacgaggtggaatagtttctgttgtttcatagcctttactttttgtggggatgtacatgcaaagataagtttattttttgaaactgttcataataagcactttattttcctgataatatagtctttccgtagaggcagattgtttttgaatcataaataaagcttaattttagctcttctgtttgcagttttttggatgtggcagcgtccattatgtaaaaaagaaacggatatgaacttgaattgtgccattttgcatgcggacccggagattgccggaagattggaagagtatatcggcaaagttccttttctctctttgcacggaaagtacggcaatcctcttgaagcgctgaaggattattatgagacaaaagtggaagtttattttgtcggcatctatccggtggaagaaggtgaaatcaacggaatggatttttgcaggctcttgtcctcgtccactcgtgtcattttcattacagacaccgaccgctatgctgccgaatgtttccgtctggatgcgttggactatctgatggacgggctcaatttctccacgtttttccagtctgtcagcaaagcggcacgctggttctctttgcaggatgcaggtacgtccgcccccaagcaaaggcaaggtccggaagaggttccgaaggtgatttacatgcggtgtgacaaccgcatcatgcggctcgacctggaacggataaactatatagaaggtatgggcgattatgtgaagattttctgtaaagattcccctaagcctatcttgagcttgtgtagcatgaagtatatggaagaaaaacttccggccgatgaatttatccgcgtacaccgttcttttattgtccgcatggactgcatcagcgccatcgggcgcagcacattgctcatcgagcagaaggatgtccccattggcgatgcttaccgcgaaagggtgaaagggtatgtgtccaggctggcagtgttgtaataccctgttttcagatactatatactttgtttgttggatctatagttccagcgtgctgcatctatatatgcaacgcgttgcatatatagatccaacaaatgataatcattcggtgtaaaatccgtgtaatctgtggtgaaccggaaccttgtattactttagttttgctctcgaaatcctttccccgaacgtcaagttcagattcaggctgaatcggctttcctgcatcagattgctgcgtgtgttcagttgtttccgccaggtggcgcccagcgaaagataggagtaccggatggggaagctcgcccctacactggcttccagatactgcatcttcccgcctttcaggttgatataggagttgccgaaacctattccacccatcagctcggtggaacgtgccagacgtggcttggtaatgtagctgcctcccaggttcactttgtgctggttctcgtatttcatggaagtgtaggaggaggagttgcggctccagtccaggtagttgtagtcggcggtcagcacccagcgttcggtggttatgctgaggccggtgccgaggtgcatgggcagatattgtgtacggctgtggtatcctttatcgaggttctcgctggtagatgagttgctgtaagtcagtgtattgtcgtggctgatgggaagggagggagcaaataccagccctgccgcccacttccgttgtccggtcgcaccccattcgtaatgtatgccgaagtccgcataaaaggtccgtttagaagattcgtactttacgacggcgctttcctgcgtttcgctttgcgtcactgtgcccgctatcatccccaggttgatgccgaccgacagttgcctgctcagtgcaaaggcattggtgacgtagcaccggtatagtccgcccgtaccctcaaagagcgagtaggtgtagttgccgggcattccctctatctcttcttcggtctggatgacatagcccacactgctgtatggtgctgcacctacaagggcataccagcgcggcaggacacggaagcccatgctgatgcggttggggttgccggtgaagttggagctgtgttcgctcagaaaggagtagcgggcatatgaggcagatgcacccacatcgaacgtgaagcaggcggtgtccatgcgggtgatggctgcggggttcagcgtgttcagaaatccggtacggttcagggcgatgcccgtgttgcccatgccggcataacgtccgccgtcaccggcactcagttcgcccactccgtacatggaggtgggcaggttggtggtgttctgggccacggcggtgaggcttgccgtacacagactgcacagcagaaggggaatccggtaatggcgtttcattgctcgttgtatattttgaatcttacgtctaatctgcattgtctctcttgttcggggtcgttggtgaagatgacctggttgaaggtggtggtgctttcttcgtctgtcagactcatcagcagtttctgccgcttgatgcccgaagtgccgtaattgttgcggatgaattcggtgaggtcgaaggagtagtaggtctctttcccgtacatctcgtcgatggtcaggtcgccggtctgtacggttacgccgtcactgccgtatacgtagtcctccagcacattgttctcgtccgtgatataaaggcggatgtcattgggaagctggctcacttcgttgtagctccgggccagaggatagaggtagagtgtggcgctctctatggagactatctgtccggcacttccgaggctgttgaggtaggggaattccagttggttgtagtaacccgtcaatccctgcatataggccaggcaacccatgtcgttggagtggacgaggttctctattccgcttttcagggaagcaaggtgggtgccggtggggtcgtgccggataccggtataggcatagtcggtgtttacgttgaaagtcagcacttgtccggtccgctggttggagacttcctgatagtggaggttgatgctcatggcagagtcgttcaccatgaatccggtgatacactgcccgtcgttttcgggaacaaaggccagtccggggaatttcttcttgaacttgtcttgggtatcgaagtagtcatcctgggccacgaggtcattcagcagttgttgtccccatgagtcgggcaggcggacgcttacttccttcttccgccccgggcagggggtgaaggtaaagctgaagagtggggcatcttccgtcgggagtacggtgctgttgtaaaggtcctcgtcgttgtccagcacgatagggtttttcagccggtagatggagatgcgctgttgcgtcagggtatctccccagaaatggcccgaaggtatcattcgcagtacgagggagtcgagggtataggtatagtctgtgttgggggtgaagtcggacgtggagtattcggcatagtaggtggcggatacttctccccaggcgctgctccggtaatgtcccagctggcagatgctgtcgccccgggtctctatggagtctagcaggatggtgctgatgtctaccgagcaggtgtctgcgtatacattatagaaggagctttccacgaggctctttccaagctgcgagttctcgtcctggcaggcgcagaagatagcgaggactgcgaataagctgtacaatgacttcttcatttctgttcttttagttggcggcaaaggaaaggcaaaacttttatatcttcctacaaaaatcggcgttcggacggtttttatcggtaaaggcgtttaacgggaatttcggactgttcgtcggttatttttgtcggtgtggttgcggtggtttacttttgcgaacagacaaaaaggacctcccgcagcttcttgttttggaaagtgggaagtataaagcttaatcattaaaaaaacaataaacaatgaacagactattggtaggaataatgttgctggccatcgtgtgcattgccggcagttgtacggacgaggatgaatacactcaggggcagtggatgaagaaagccagctataacggtgtgtaccgcgcttatgcctccggcttcaccatcggcaattatggatatttgtgtggcggcttctacggagcgaacaaggattacctgaacgacctttgggagtatgacatgagccggaacagctggacgcagtgtgccgacatgcccgttgccgggcgcaaggctgccgtgggctttgccgtgaatggcaagggatacattacgaccggttccgtaaaggacggctcctcgtcctactgtgtagcagatacctgggagtatgaccctgccacggatacctggacacggaaagacgacttcaaaggtggagtacgcgatggtgccctggctttcagtataggcggatatggctatgtcggtacgggctgcaacagcgacgctaccggcagcgagagtgcctacaagatggacttctaccgtttcaaccccaatggcgccgaaggttcgcaatgggaagcggtgagcgggtatggaggcgagaagcgctacttcggtacggcattcgtcatcgatgaggtggcctacatctgttgcgggcgaaacaacagtaccgatctggtggatttctggaagttcgacggaagcaactggacccagttgcgtgacattgccgatacggactccgacaatgactatgacgatgactacgccatcacacggtccgaagccgtatccttcgtcatcggtggaaggggatttgtggctacgggaatacgtaacagcacttccctgagcagcgactactggctgtacgaccctgacaaggacttatggtacggcgattccgatgacgactttacccccattacagatgtacataattatccttccggtgcttcttcgcgcagggctgccgttggtttctctaccggtgaacgtggttttgtgctgacgggaacaagtggtaccagctactttgatgatgtgtacgaacttctacccgatgaggaagaggaagtctgattcgccccataactgaacggaacttatgaagctgatgtttattatgataaagataggtgtaccggctgtgatggcggtatgcctttcttgctgttcgggtcatactgccggcggtggcaatgagttgaaatgccgggtgatggaggtggaaggcggttacggctacgtggtgctgcatggagccgataccctgatatatcaaccttttatacctgctttgagcggtcgcctgccatttgcaacaaaggtggaagcgctggcggccggtcggctggtatgccgtaagcttgccgatgggcaagctccggcattgagcagggaggaggtggagtcttgtctgacagacactggactctaatcttctaaagaatcctttacttcgtgatgtatttccgagcagtcataagggtatctctgcatgaatttacccttgagtaccttctttgtatcgctatcgggacgtgaaagggtggcggtgaatgtcacttgaagccgtttgtagtagatggttgaagtgtatatgttccatttcatgcccactatgtctacttcaaaatgtttatatctcagttcgtcttctttgtaatacttgccttggttgatgaagaataacagttgttgtcccatgattatttttccgtcttctatgtggttgggcagatagatgctacgtttctccgggtctatgcttttgaaggtttcatcagagtgcccatcgggtatgaatgcgtattctgtccatttattgatgaatggatagtagtcatgcttgtcggttgtgtttcccagattttcatttttataggtactcttatcaggtcctgttccggcttctttcactccgtcaccttcttccacgctgtattcgatggactctatctgatagaagttagtgcacggttcttggtgtatgatgatttgttccttgtagagtcccgttttcatctcaaggttgatgatgaggctacgggattcacctaagtcaaagttgtctttaaagtgcaggatgagatggctgtcggtgtcccgttccaagtcccaccatttataatgcaggcttcccgtaccttccagttgtgggagcttgttgccatccatcatgaggtctccccatggggtggtgatggaggttatgcgccagtcgccgcgtgttaggtctatctgcagggtagaggcttcgcccttcacggtagtttcctgaaagggcgagaggcggatttcatcgctatcattgcaagccgtcaggccgcaaaggaaaagagcgaacaaaaggatggattggaataagtcagtcgttttcatgttggttattatttgattatgtccattggacgtggcattctttgtaaatgctgcacgacaaagataattatttcctctttacgctgtattctccgaaagaaagaagtactcttttttgccggataatacgggttttattaacttgcgcacaaattatcgctaatcattaaccactaaccattaattccatgaaataccaagttgccattatcggtggaggtcctgcgggatatactgctgccgaagctgccggaaaagcaggattgagtgtcgtactatttgagaagcagagtctcggtggagtgtgcctgaatgaagggtgtatccctaccaagaccttgttgtattcggccaagacctatgacggagcccgccatgctgcaaagtatgcggtcagtgtgcccgaagtatcgttcgatttgcccaagattattgctcgcaagcagaaggtagtgcgcaagctggtattgggagtcaaaggaaagctgactgcccatggtgtgacgattgtcagcggaggggccacagtgacggacaagaatcatgtggagtgcggcggagaaacctacgaatgcgataacctgctgctctgcaccggttccgaaacctttgtccctgccattcccggcatagacaaagtgtcctattggactcatcgtgatgcactggataacaaggaactgcccgcttcgcttgccatcatcggcggcggtgtcatcggtatggagttcgcttctttcttcaacagcctgggagtgcaggtaaccgtcgtcgagatgttggacgagatactgggaggcggtatggaccgagagctggcgggtatgctccgtgcagagtacgctaagcggggaatcaagttcatgctgagtgcaaaagtggtatctgttgcacaggatgctgccgaagcttcttcccttatccaggtgaattatgaaactgccgacggtcccggttctgtcgttgccgaaaggcttctgatgagtgtcgggcgccgtccggtaatgaaaggcttcggattggagaatctgggcttggaaagaacggaacgcggaaatgtctttgtcaacggacagatgcagacctccgttcccggagtatatgcttgcggtgacttgacgggatattccttgctggcgcatacagccgtccgcgaggcggaagtagccatacattccatcattggcaagaaggatgccatgagctaccgtgccatccccggcgtggtatataccaatcccgaaatagccggtgtgggcgagacggaagaatcccttcagaagaaaggcgtagcctaccgtgcagtgaagctgccgatggcgtacagcggtcgtttcgtcgccgagaacgaaggtgtgaacggtgtctgcaagttactgttgggtggcgacgataccgtattgggggcacatgttttgggtaatcccgcttcggaaatcatcacgctggcaggcatggccatcgagctgaaacttactgccgatggatggaagaagattgtctttccgcaccccacggtgggagagatattcaaggaggcattgtagaacccatgactattgtttcatataaacataaaagatgaaaaccgtaaagctaatcacctgcgacgatgccttccaggcacacgtcattcagggtgccttgaagaatgagggcattgcgtctgttttgcataatgaaaacatgtcttccgtgatgcgcggatatgtccgtgatgtcacgggagtggatatatttgtttatgaagatgaatatgacaatgccctccgcctgcttgaacggaaccagatgattccggaacagttgaggtactgcccccattgcggttcggatgagattaagtttgtgctgaagaagagccatcgggtgcgtgctgtggtggctgctgttattgcggcattgtcggccgcacctccgggcactgagcattgggagtatgtatgcaggaagtgcggcactcattttgagaagccagtggcgaaaggaacagttgaagaataattaggtgtttattcttttaaccgcttttcaatccagacccggtttttacgtcccaatcggctttccgcaaaatccaggaaagccgatgtgtctgttatatgggcttggatgacacctgccagaaagttgaagaaaggttcttcacccacccggacaagcaggtcggcgagtagtactgaccctttcctatagagggcaagatgcgcttcgcggtcgttgcggtcaataccccagataggacggatatggcgtgtttccttacggtaggcgtcgatgtaagcggcataggctttttcgccgcgggcgtggcgtatgtattgcaaagcactgaattcggcaaaagattcgttcagccagtcgtgccaagattccaccggagccttgttccaccagaagtggccgatttcgtgggcggtgttcttgagtacatattcattgaatgttcgggaactgagcataatgaaatttttacggctgtaccctcctgaggtgccggaagctgaaagcaggaatttcatgtaaatatcctcatctcccgcaattttataaaggcgtcggaagaatttcaaggcattgtggcaacattgaagtgccgagtctgcatcggcatccgggaagtctgtatagataagttcaatggtagttccgttatcattgatgcggcggcttttcagcatgggtgaagccaggataacattgtcgaaattctcccaaggttgctccatttcccatatcccttcttctgtatgggaaataatacctgagccgctcaccgtataaccgtcagtgatgccgattcgtaagtgcgaataatctgcccggttaccgttgcagacaggataccatcccgtatagtaaccaagttcaatccaatggtcattgaatgattttgcagggccctgcacttcctgcatgtagagtgtgtaacgggtatttatgcggcagcggtcatcggctcctgccggccggtagagggtcaaggtccgtccgtcgggaatgaattgggcaggtgctggggcaagcgtatcgaaacggtaggttatctcccggctgctgtggcgtagtgtgtcgatacgggcatggcgccatagtaccaacgagattgagtcactgtcatggaaatcgacttcaaacgaaccgccaacttcgacttgtcggttcggtacatcaatctgtacggttaagtcataactgacaatgcgcggagattcttgtgcccgaagcatgggggagaaaaggaggcatattgtaaagctggcaattgtaagttgtagtttcatggtacatcaattttagagtgatagtaactgggagattttgcctatgcaatctatgcaaaagtagtatttttaaaggaatattaagatggatggctggatataatttatgaaaagactacctcgttgttgttcatttgtaagattgtcgtacttttgcctttaaagataaatatatttatgaaaaggatattgttgctgttaattttatccgtctgcctgctcccattatggccccaagagacggtaactccggtgaagccgctctctgcgcggattgatgcgttgatagaacacaaacttcccgcaggctctaatgtggccatttcggtctatgacctgactgccggaaagcccttgtacggctatcaggcggacaagctttcccgtcccgcttccaccatgaagctgctgaccaccattaccgccctttcccgtcccgaagccgacgagccgttccgtacggaagtgtggtatcagggaaccattgagcgcgataccttgcagggggatatgtatgtgataggcggttacgacccggagtttgatgaagaggcattggattccctggtggctgccgtggcccgtttccccttctctgtcatcaaaggcaaggtgtatggagatgtctccatgaaagactccttgtactggggcagcggctggttgtgggatgatactccctattccttccagccctacctctcaccgctgatgctgaataaaggagtggtgaaggttaccgccacacccggcgaacggggcgacagcgcacgccttgaatgcactcccgcctcttcctattatacactgacgaacaagacccaaagccgtaccccttctgccggacgtttccgtgtgtcgcgcgactggctggtgaacgggaacaacatcaccgtgacgggcaacgtcgatgcccgccgtgcaggtacggtcaatatattttcttcgcaggacttcttcatgcatacctttatggaacggttgcaggcacgaggcatccggtgcattccgacggcagaagcggaagtctcttacctcttcggcgagttccggcaagacagtctttccgtgcggatggcttcctatgaaacttccgtgcaggatgtggtgaaacagataatgaaggagagcgataatctcaatgccgaagccatgctctgccggttgggtgtgcagagcagcggaaagaagcgtgtctctgccgaggacgggctttccgccatccgcatgctgataaaagagatgggatataaccccgataggtataatctggcagatggttgcggcctttccaattacaactacatttcaccggaacttttggtttctttcctgcgatatgcctactcgcgtacggatgttttccggaaactttataaggctttgcccattggcggcgtggacggtacactggagttccgcatgaagaaaggcaccctttcccacagaaatgtacatgccaagacgggttcctttaccgccatcaactgcctggccggctaccttaaagcccgcaacggacacgagatagcctttgccatcatgaaccagaatgcactgtcgggcagggaagcacgcgctttccaggatgcggtgtgtgatgaagtgatacgttgaggtttagccatcgtaaagttgacctttagcgtcgtaaagttaaggtttagcttcctaatgcagacctttacggagtgagccccaagagtaggggaaatcattcctctttcgtattgcggtagcgtgccggagacatacccagataagacttcacatacttcccgaagaaagactggttggggaaattaaattcttctgcaatctccttgatggacttgtccgaatgcttcagccggtacttgatgtgctcgatggcactttcgttaatcaagtccagcggtgtacgtccgcatgcctgcttgatgaccttcgaaaagtgtttgggactatagcagagtgcatcggcataatatcctacagaacggtgtatgccgttgtctttggacaacatctctataaacttacgcaggatatagtcggactgtttgatgctttcttttgtatcgactgtcatttctgaagggttcacttctttgttgaggtgtcccaacatctcacagaaaatggcagaaaacaagtattgcatcacttccctgtgatagtgatgaggctcgtcgtttatctttgccataagcagttcccggtagaatttgaagatttccttgtccccttcctccccgacagactttatgggattgttgtggatatgcataacggtattccatgtatccttctccatcttgaccacgcgttgtaggaactgtgtggagaatgcggcaagccttatcttgtgcttcgggcttaccatcgcgtggctgataatggtattgggaaggccgagcagtaagtcgcctgcttccagttggtaggttttgtagttgacgtccaactggatgcagccttctagacagatagcgataaggaagcatcccaatcttattgtatcttcattgtaggggcttccctccagactgttgattatgacaaagtcattgtctacatagtcaaggacatgttcgctgtttttaaagtccgcgatttctacgatttttatgttccctttctccatattcttcctttttcgttttgcaaagttggtgaataatgggaaatatgggatgttccattatgtggctttcttgttctatatgtcatttatagacaattcattagccttaaaaaagatgaatgtcgaaaaaggaacatctttggagtgtaattggtcattatggcgttgttcctttctcctacttttgccaccagttttaacaaaaagacaatgagaaaaagtatgattacattgaacaggaaatggatacggctgatagggattgtcggttgtacaatgtgtttggcatcttgcaagcaggcatcggatgcttccggaatgaaaccttcttacgctaccatgaaagtggaggcgacggacaaagagctttccacttcgtactcggcaacgatacgcggacggcaggacatcgacatctatccgcaagtgtcgggcaccatcgagaagctttgtgtgaccgaggggcagaaggtgcgccgcggacagttgcttttcattatcgaccaagtgccctacaaggctgccctcaaaacggccgtggccaatgtggaggctgcacgtgctgcactggctactgctgcactgacttacaacagcaacaaggaactgtatgcgcagaaagtggtttcggaattcagtctgaagactgccgagaacgcctaccttaccgccaaggcacagctctcgcaggccgaagcccaggagataagcgcgcgcaacaacctttcttatacggaagtgaaaagtcccagcgacggagtggtgggagcactgccctaccgtgtgggcgcattggtaagcgccagtctgccgcagccgttgacaacggtcagtgacaacagcgacatgtacgtttacttttccatgaccgagaaccagttgcttgccctgacccgccaatacggaagcatggacgaggcattgaagaacatgcctcaagcggaactgagactgaacgacaattccgtctatgacaagaaaggaaccatcgagtccatcagtggcgtcattgaccgtcagacgggtacggtagtggcacgtgtggtatttcccaatgaatcgcgcctgctccacagtggggcgtcgggcacggtggtggtgcctaccacttataagaactgtattgtgattccgcaagaggccaccgtgcagttgcaggacaagacagtggtatataaggtagtggatggcaaggccgtttctgccttgattaccgtggccggaataaatgacggacgcgaatacgtagtgctggacggactggaagtcggcgacgagattgtatccaccggtgccggactgctgcgcgaagggacgcaagtgaaatgatgaactgctatttatcaactatcaatgacccattaagatgaaaggaaatatatttataaagcggccggtgatggctatctccatctccgtactgattctggtgatagggcttatctcgctctttacgctgccggtggaacagtatcctgatattgcacctcccacggtgtacgtcagcgccaactacaccggtgcagatgccgaagccgtattgaacagtgtcatcatgccgttggaggagagcatcaacggtgtggagaacatgatgtacatcagctctaccgccaccaatgccggttctgccaccatacaggtctacttcaagcagggcacggaccccgacatggctgcggtgaacgtacagaaccgcgtatccaaggcgcagggactgctgcctgccgaagtgacgaaaatcggtgtgactacccagaagcgccagaccagcttcctgcaaatcggtgctttggtaagcaccgacggacgctacgaccagactttcctagccaattacctcgatatcaacgtgattccgcagattaagcgtatcgaaggtgtgggtgatgtaatggagctgggcgatacatacagcatgcgcatctggctgaaaccggaacggatggcgcagtatggactggtcccttcggatgtgaccgccgtattgggcgagcagaacatcgaagcgcctaccggttcgctgggcgagaattcaaagaacgtgttccagtttacgatgaagtatcgcggacgcctgaagagtgtggaggaattccagaacacggtggtacgctcgcagagtgacggttccgtgctccgtctgaaggacgtggcggatgtggagctgggtacgctgacctatagtttccgcagtgagatggacagcaagccggcggtacttttcatgatgttccagacggcaggctccaacgcaaccgccgtcaacaagcagattaccgcacagatagacgagatgaggaagagcctgcccgaagggacggaatttgtgacgatgatgagttccaacgacttcctcttcgcttccatacacaatgtggtggagacactggtcattgccattatactggtaattctggtggtgtatttcttcctgcaggacttcaagagtacgcttataccctccatttccattatcgtgtcgctggtcggcacgtttgcctgcctggtggctgcggggttcagtctcaatatcctgacgctgtttgcgttggtgcttgccatcggtacggtggtggacgatgccatcgtggtggtggaggcggtgcagtccaagttcgatgccggatataagtctccctaccttgccacgaaggatgcgatgggcgatgtgacgatggctatcatctcttgtacctgcgtgttcatggcggtgtttatccccgtgacgtttatgggtggtacttcgggtgtgttttatacgcagttcggtgtcacgatggcaacggcggtgggcatctccatgatttcggcattgacgctttgtcccgccttgtgtgccatcatgatgcgtccgtcggacggtacgaagagtgcgaagagcatcaacggacgggtgcgtgcggcatacaatgcctcgttcaacgccgtgctgggcaaatataagaaaggtgtgatgttcttcatccaccaccgctggatggtgtggacttcattggcggctaccgtcgtattgctggtttacctgatgagtaccaccaagacggggcttgtgccgcaggaggaccagggtgtcatcatggtgaacgtcagcacgtctccgggaagcacgctggaagaaaccacgaaggtgatgaacaagctggaggacatcctgaaaaacactcccgagatagaacactattccaaggtggcaggatacggattgatgtccggtcagggcacttcctacggtaccatcatcatccgtctgaaggactggggcgagcggaaggggagcgaacacacgtccgacgctgtggtggcccgtctcaatgcacagttctacggtgtgaaggaggcacagatattcagcttccagccgggtatgattccgggctatggtatgggtaactccctggagctgaacctacaggacagaacgggtggtgacatggctacgttctacgaggcagtgatacagtttctgggtgcgttgaaccagcgtcccgaagtggctatggcgtatacctcttatgccatgaatttcccgcaggtatcggtagatgtggatgctgccaagtgcaagcgtgcgggtatctcgccgggtgcggtgctcgacgcattgggcagctattgcggcggtgcctatatttccaactacaatcagtttggcaaggtgtaccgcgtcatgatgcaggcatcgcccgaatatcgtctggacgaacaagcactgggtaatatgtttgtgcgcaacggtacggagatggctccggtcagccagttcgtgacgttgaacaaggtgctcggtccggagacggcaaaccgtttcaatctgtacagcgctatcgccgctaatgtgaatccggcggaaggatattcgtccggtgaagtgcagaaagtgattgcggaagtggcagaacagacattgccgctgggctacggttacgagtacggaggtatggcacgtgaggaagccaatactggtggtgcgcagactgtctttatttatgccatttgtatcttccttatctatctcatcctggcatgtctttatgagagtttcctgataccgtttgcggtcatcttctccgtaccgttcgggctgatgggttcattcctctttgccaaggttctgggattggagaacaacatctatttgcagacgggtgtgattatgctgattggcttgctcgccaagacggccatcctgattacggagtatgccatcgagcggcgccgcaagggaatgggcattgtggaatcagcttattcggccgcccaggtccgtttgcgtcctatcctgatgacggtgctgacgatgatattcggtatgcttccgctgatgttctcgagtggtgcgggcgccaacggtaactcttcgctgggtacgggcgtagtaggcggcatgctcatcggaacgctagcgctgcttttcgtcgttccggtgttctacatcatcttcgagtacttacaggagaaggttcgtccgccaatggaggaagaagccgatatgcaggtattgcttgaaaagcagaagagtgaggcagaacgggcgaaagattgaggaaaataaaataaaaacagattggaacaatgaagaaacatatcatcctattgtccgccgccggtttgctgttcagcagttgcggcgtgtacaccaaatacaaacctgctaccgaggtccccgacggcctctacggggaagaaatagccacttttacggagagcaccgacggttctccggtggctcccgaagacagcctggaccttggcctgggcggcatggactggcacgagcttttcaccgacccacatctgcaggcactcatcgaacaagggttgcagaacaataccgactaccagtcggcacagcttcgcgtggaagaggccgaagccaccctgctgtccgcaaagcttgccttcctgccctcctttgcccttgcgccgcagggcacggtgagcagctttgacagccacaaggccacacagacctattcgctgcccgttactgccagttgggagctggatgttttcggccgcatgcgcaatgccaagaaacagtcgaaggcgctctatgcgcagagtcaggactatcgccaggccgtgcgtacccagctcattgccgggatagccaatacttactataccctgctgatgctggaccagcagcttgccatctccaggcagaccgaagagacgtggcgggaaaccgttgcttccacccgtgccctgatgaatgcgggcatggcgaacgaatccgccgtgtcgcagatggaggccacgtactatcaggtgcagacttccgtgcttgatttggaagaacagataaaccaggtggagaacagccttgcgctgttgctggcagagacgccccgtcattacgagcgcggtgtgctggcagagcagcagttccccgtgggcttttctatagggattcctgttcagatgctttcctgccgtcctgatgtccgctcggctgagcggacactggaagcggcgttctacggcaccaatgcggcgcgctctgccttctatccctccatcacgctgggcgggagtgcgggctggaccaattccgccggttcaatgattgtgaatcccggcaagttcctggcttcggcagtgggttcgctgacgcagccgctctttgcccgcgggcaggtcattgcacagtaccgcatagcccgtgcccagcaggaggaggcttcccttgccttccagcagacattgctgaatgcaggcagcgaggtgaacgatgccttgactgcctggcagacaagcctatccaaaagcgaactgctggacaagcaggtagcttccttgcagacagctgcccgcagcacttccctgctgatggagcatggcaacaccacctatctggaggtgcttaccgcccggcagacattgctcaacgctcaactggcacagacggcaaaccgattttctgaaatacaaagcctgattaacctctacaaggcgttagggggaggtcaggaatagagtgtcatcatactactctctctgcatcttcactttaaatgtgaaggaagggctgtccgggaagtgattccaggcagcccgttttcaatgaataggagggatcaaatggaggcaagtatttctctggacaaattattgcagtttttcactcaatgcgaacgataagcgttggctcggtgagagatcgattgaagaaactgaaaaggaaactgaagcaaaagatagtgagtttaccggtaagaaggaggttttgccaggaattgatacagggatgtagtaggtactgaaatagcttgttgttggaactatagatgcagcgtgttccatctatatatgcaacgcgttgcatatatagatccagcaaaccggaaatatacatgcaacgcggtatatctttcgggcggtttttctccgcctttttagggagcagtttatttatactgtgcccagtctacattcttcatgtctccacttttggccagctcagcgtgcatagccagtgcggcgcgcagggcatggggagtctgtgacttgccgtcagtcagtttcaggtaatcccacagaatgttcttgtagtccggatgaacacagttttcgatgatggcttgtgcacgttctttcggactcttgccgcggaggtcggccacaccttgttcggtgatgatgatgttgacgtcatgctccgtgtggtccatgtgcgaaaccatcggcacgatagccgagattttaccttccttggcaacggacggacaggtgaagatggagatataggcattgcgggtgaagtcaccgcttccaccgataccgttcatcatcttcgtaccgccgatgtgcgtggagttcacgttgccgtagatgtcggcttcgatggcggtgttgatggagatgataccgagccggcgcaccacttccgggctgttggagatttccgacggacggagcaccagtttgtcgcggaagaagtccatatcctggtagataccttccagacagtcgttcgttacggtcagtgagcaggcgctgccgaatttcacgcggccttcgcggataagtccgataacggagttctggatgacttctgtgtacatttcaaaagcggggatggtcttgtcacgtcccaaagcacccaatacggcattggcaatgttacccacaccggattgcagcggcaggaaggtaggcggaatgattccgcgtttcatgtcggcggcaaggaagtcggccacgttctgtccgattttgtcggtcagcgggtcggcggcggcaaacgaacgtgcctcgtccggccagttggtctccactacgccgacaatctttttcgggtctacctggatgtagggcaggccgatacggtcactcggtttgtagatggggatttcgcggcggtaaggagggtcgaggggttcgtagacgtcgtgcaggcccatggcgttcttgctgtgggcggcattcagttccacgataatctggtcggccaggcggcagacagtcggagcgataccgccggctgccgtcaggtagattttaccgtcgggagtaacctcgcatgcctcgatgatggcaacattcacttttcccatgaaaccgtaacggacttcctgagccatctgtgaaaggtggatgtcgttgtaggctatttcaccgttgttcacggctttacggaaatcggcgttggtggtgtaaggagcacggtagcggatagctttggcgcgtgaaaggataccgtcgcaggaatctccggtagaagcaccggtgaagatacctatctggaacgggtttccttttgcatgttctgcttccgcgatttttgctaattcagccgtaacggctttggctgttcctgcgggggtaaatccgctcaagccgatgttgtagccatgtttaatcaggctcgcagcttctgctgccgaaatgtaattgagtgccataatataaatagttattttttcgtgtaaagattctgaaggggctcgtaattggttctgcaattatcgactgtctttaatatttccgttgaagtatttctgaccagatgatggctttcctcgcttcttctgccgagtggatgccgtattcggacgttacttcatcggattcctgcggacgggatgccggggagggaggggaagcctttatggaagtgtgcttggatttggcagacggtttggataccggcttgggcttttctgccggcttggggccttcgggaataaagcctccgtaagtatctccgccccagtattcgggcagtgggttgtcaacgtcgggcataggtatgtcgggactcttgtcagcatttttatttgcttctttcttaaactgcttgacgagtccgattactatgacagccgcaactaacagaaacttgaagacatcttccatattctttttgattttccacccaaagatagtgcaattatctcttatctttgcttttgggcaaagttaattatttaatctgattacagccaaggaattggtaataaaaaagggcagcttcacagctccccttaatttttttaacctaaaccttaactatgaaaaaatctaatgtttctttcattccacaaatttgtgaattaatttgctctatgccaaattaacactcggaaaatgtttgctctcttaacataaattagctgataaggcgcagattgacaacttgtaatggcatttttctttcatttcatccgtttattgggagggaagaagtatctttgcgctccggatgacagataccaacttatgatataaactgattttaaacgaactgattatggaaaaagtaacgggagcagactttaaatctgcaactgctgatgacaacaagaagttgtttatcgagacttacggctgccagatgaatgtggccgacagtgaagtgattgcatccgtcatgcagatggcaggatattcggtggccgacaccctggaggaagccgatgcagtgtttatgaacacctgctccatccgcgacaatgcggagcagaagattctgaaccgtctggagttcttccactcgctcaagaagaagaaacgcggcttgatagtgggtgtgctgggctgtatggcagagcgtgtgaaggacgacttaatcaccaaccatcatgtggacctggtggtggggccggatgcctaccttactctgcccgaactgattgcctcggtagaggccggtgagaaagcaatgaacgtggagctctccaccacagagacctatcgggatgtcatcccctcgcgcatttgcggaaaccacatctccggcttcgtctccatcatgcgtgggtgcaataatttctgtacttactgcatcgttccctacacccgtggccgtgagcgtagccgtgatgtggaaagcatcctcaatgaagtggccgacctcgtggcaaagggttataaggaagtcaccctgctgggacagaacgtcaattcctaccgcttcgagaagccggacggagagacgattactttcccaatgctgctgcgcaccgtggcagaggcagcgccgggcgtacgtatccgtttcactacctcgcaccctaaagacatgagcgacgaaactctccaggtcattgccgacatgcccaacgtatgtaagcacatccacctgccggtacagagtgggagcagccgcatcctgaagctgatgaaccgcaagtacgaccgcgagtggtatatggaccgcgtggcagccatccgccgcatcatccccgattgtggcttatctacggatatattctccggtttccatagtgagacggaggaggaccaccagctttccctctcgctgatggaggagtgcggatacgattccgccttcatgttcaagtacagcgaacgccccggtacgcatgcttccaagcatctgccggacgatgtgcccgaggaggtgaagattcgccgtctgaatgaaatcatcgccttgcaaaaccgtctctctgccgaggcgaatgcccgttgcgtgggcaagacgtacgaggtgctggtggaaggtgtttccaaacgcagccgcgaccagttgttcggccgtacggagcagaaccgtgtggtggtgtttgaccgtggcacgcaccgtgtgggcgattttgtgatggtgaaggttaccgaatccagttcggctacgctgaaaggagaagaggtagccggctgacgggatagaaaagtctcgatgacatcagtatgatgacaccggtatatagaataaaagcacgagccgtgaggctcgtgcttttcatattataaactttaaattttattctgtcatggccagaatattcgctacgtagtcggtcttgttgtagcttaccaaggtcaattcggactttggaacgtcctggttgtagagtttgtaagctaccggcatgttttcatcgttcaattcatacacacttttcttcatgtctttgtcataagccttgtgagactcgttccaacgtgcgtaggacatggtgatttcatcattgccatattggtatgtcattttaaagtaaggtatccattcatcttttgcaccgtcccacttggaggcttccttgcaggtcaggcgtttctggtcgtcataagagtattcataacggatgtgccggtaaagttgtgcgccgtcttgcttaaagatggtcttggcaactactaattcgtttttcacttcttcattggtgatgaagttgttttcctgagctttcacttctgtattcataacgcttacgatagtcattgctacgaatgcgactgccttgaataaatttgtagttttcataatctttatttttaattgttgttacttactctgtttcttttagacgttgttcccgattaaaaggttgcattccaactaatctttttctcaaacgccttcgcctaattatagtcaattcccatgccaaatatttaagttgttgataatcaatgaataaatgctttcgaaaactgttcattatcggacagttgtccgcttaatatcgaacagtcggtcattcgttccgccggctggccggagtaagcgtttgttttcttaaatctccttaatggaagccctataaatcactttttatttgttattttgcaccaaatttaggtatagtgtggtctgtttcatttgggctgcacttccttattggcagaacgttcgatgaataaactcactataaaagcttgtccgttatgtggtggaacgcatttggagcgtgccctgacatgtgtagaccattatgcctcgggcgaaatgttccacttgtgccgctgccgggattgcggtttccttttcacgcaagactttcccgtggaggctgaaatcggtcgttactacgaaactcctgattacatttcacataccgatacccgcaagggggcgatgaactccgtgtaccactgggtgcgcaactatatgctgggacgcaaggcacgtcttgtggtccgtgaagcacaccgcaaggagggccgtctgctggatttgggtacggggaccggttactttgccgatgccatgcagcgtcgcggctggcaggtggaagctgtggaaaagagtgcgcaggcgcgtgcctttgccaaagaacacttcaatctggatgtgaaaccccatacggcattgaaagattttgcaccgggcagtttcgacgtcatcaccctatggcatgtcatggaacatctggaaccccttaacgaaacgtgggaaaccctgcactccctgctgactgaaaagggggtgctgattgtagctgtgcccaactgctcttccttcgatgcaaagaaatacggggcttactgggctgcctacgatgtgccccgccatttgtggcacttcacaccgggcaccatccagcaattcggttccaagcatggcttcatcatggcagagcggcatcccatgccgttcgatgccttctacgtctccatgctgacagaaaagcacatgaggcactcgtgtactttcctgcggggaatggtgaccggtacactggcctggttcagcgcgttggtgaagaaggaacgcagcagttccatgatttacgtgttcaggaagaaagggtgagaaaagggattagggattaatgattaatagcgactgatttacataacttgtagcttgtaactcgtaacttataattgatataatgaaaggaaagaataactcggtatcctattttgacatgcagttcattacgtccagcatcagtacgacgctggtgttactgctgttggggctggttgtattctttgtgctcgcggctcataatctttccgtgtacgtcaaggagaacatcagtttctccgtgcttgtcagtgacgacatgaaggagagcgacatcctgaagcttcagaagaggctggacaaggaggcttttgtgaagcagacggaatacatttccaagaagcaggcactccgcgagcagactgaggcgatgggtacggacccgcaagagttcctcggctacaatcctttcactgcctccatcgaaatcaagctgcattccgactatgccaattcggacagcatcgccaaaatagagaaactgattaaaaagaataccaatatccaggaagtgctctaccagaaagacttgatagatgccgtgaacgataatataaggaatatcagcttgatgctgctggggctggctgtgatactgacgtttatctcctttgcgctgataaacaacaccatccgtctggctatatattccaagcgtttccttatccacaccatgaagctggtgggagcaagctgggcattcatccgtcgtccgtttctgcggcgcaatttctggataggtgtgctggccgctttcatagccgacagcattctgtggggagccgcctattggctggtgtcctacgaaccggagttggtcaaggtgattacgcccgaggtgatggtgctggtgtcgggtgccgtgctggtgttcggtgtacttattacgtggctgtgcgctttgctttccatcaacaaatatctgaggatgaaggcaagcacactgtattatatttaacgccttgaagtgcatagagagaaagcactgttatcgcagcctccaaatagtaaattgtaaatagtaaaatagtaaatgtatagatgagtaaagagaaattcgcttttgataagaccaattttatcctgcttggcatcggaatggcggtggttatcattggttttcttctgatgaccggccccgtgtctaccccgacgacctttgagccggacatttttagtgtgagacgcatcaaggtggctccggtagtttgcctgctggggtttgtgttcatgatatatgccgtgctgcgcaagcctaaaagctgtcgtgcagaggagtaaactttcagacgcggattacacagatgacgcagattggaatattagaaatccgtgtcatctgcgttatctgcgtctgaaaaataatcagaaagaaagtagtaacagagcttccggacagcccctccggcaactcaagaacttaaaaacttaaacaaattggaatggtttgaagcgcttatccttgggcttattcaaggactgaccgaatatctgccggtgagcagtagcggacacctcgccatcggttcggcattgttcggtattgagggagaggagaatcttgcttttacgatagtggtacatgtggctacggtgttcagtacgctggtgatactctggaaagagattgactggattttcaagggactgttcaagtggcagatgaacgaggagacacgttacgtcatcaatatactggtatccatgatacctatcggcattgtgggggtatttttcaaggacgaagtagaggccattttcggttcgggactggtcgttgtgggctgctgcctgctgctgacagctctgctgctgtctttctcctattattataagccgaagcagaaggagaacatcagcatgaaggatgcctttatcatcggtctggcacaagcatgcgcggtgcttccggggctttcccgttcgggcagcaccattgcaaccggtctgttgctgggcgacaacaaggcgaagctggcacagttctctttcctgatggtgatgcctcccatcttgggtgaggcactgctggatgggatgaagatgatgaaaggtgaggcggttgcgggggatattccggcgctttcgctggtggtaggtttcctggctgcttttgtttcgggctgcctggcctgcaagtggatgataaatattgtgaagaagggcaagctgatttattttgccatctattgcgcgatagccggtgtcataacgctcatattaagctaaagtcccctccttgtgtgggggaaagactgattactccggaaatcaataagagaaaaatattaagttgtaccattttatccccctccctaccggggaggggttaggggagaggccaatgaattttaaagaaggagaagtcctctatttcaataaaccgctgggatggacatcgttcaaggttgtgggacatgcgcgttaccacatctgccggcggataaaggagaagaagttgaaagtaggccatgccggtaccctcgacccgcttgctacgggggtgatgatagtctgtacgggcaaggccacgaaacggattgaggaattccagtatcacacgaaggagtacgttgccaccatccggttgggtgccaccactccctcttacgacctggaacatgagatagatgccacctatcccacggagcacatcacccgcggactggtggaggagacgctgaagaagttcatcggcgagatacagcaagtgcctcccgccttctcggcatgtatggtgaacgggaaacgtgcctacgaccttgcccgcaagggagaggaggtagagctgaaacccaagttgctcgtcatcgacgagatagagctgctggacgacgggctggatattgccgaaccgtggataaaggtacgcgtagtatgcagcaaaggaacctatatccgcgccctggcacgtgacatcggcgaagccctgcagagcggcgctcacctcaccgccctggagcgtacccgcgtaggcgacgtccggctggcagactgcctcaatcccctcgattttaaagagtggatagaggcgcaggagatagatatttagttataagttatgagttatttgctatgaagtgtagtatactgccggataactcataccctcttatgactaaaacagactgatataaataataaataacttataactcataactaattatgaaactgtcgcaattcaaattcaagcttcccgaagagaagatagctttgcaccccacgaagtacagagacgagtcacgtctgttggtgttgcaccgtaagacgggtgagattgagcacaagatgttcaaggatgttctggactattttgatgacaaagatgtgtttatcttcaacgacaccaaggttttccctgcccgcttgtacggtaacaaggaaaagaccggtgcgcgtattgaagtgttcttgttgcgtgagttgaacgaagagctccggttgtgggatgtactggtggatcctgcccgtaaaatacgtatcggcaataagctctacttcggtgacgacgactccatggtggctgaggttatcgacaacaccacttcgcgtgggcgtacgcttcgtttcctttacgacggtccgcacgatgagttcaagaaggcgctctatgcgctgggcgaaacgccgctgccccacagtatcatcaaccgtcccgtagagccggacgatgccgaacgtttccagtctatttttgcacgcaacgaaggagctgttacggcgcctaccgccagcctgcacttcagccgcgagctgatgaagcgtatggaaatcaagggtattgactttgcctacatcaccctgcatgctggcttgggtaacttccgcgacattgatgtggaagacctcaccaagcacaagacagactccgagcagatgattgtgaacgaggaagccgtacggattgtgaaccatgccaaagacctgaaccgccaagtctgtgccgtaggtaccaccgtgatgcgtgccatcgagagcactgtcagcaccgacggacatttgaaggaatacgagggttggaccaacaagttcatcttcccaccgtacgactttaccgtggccaatgccatgatatccaacttccacatgccgctcagtaccctgctgatgattgttgccgctttcggcggttacgagcaggtgatggaggcatacaatgtggcattgaaggaagagtaccgctttggtacgtatggagatgcgatgctgattacagaccggtaattatggttgtttatttcagtcttggtaccaatctcggcgataaggagcagaacctccgcatggccgtccaaaagataagaaagcagataggggaagtgatttccctatctgctttttatgctactgccccgtggggcttttcttccgataatatttttctgaatgccacactctgcgtaggcactgctttggcacctttggaggtgttgcaaacgacgcaggaaatcgagcgggagatggggcgtacgcataagtctgtcaatgcagtgtatagcgaccgtgtgatagacatcgacctactgctctgttttgccgatgacggtactcccgttttgctggatacgcccgaactgaaacttcctcatccgctgatgcaggaacgccgtttcgtgatggagccgttggcagagattgcttcaggcgtggtgcatccggtattgggaaagacaatcggggaattgttgcaaaatcagtgttaatctctgctatctgtagcgcagatacaagatttcttttttatctttgcctccggaaagcgaagataggctgcacctcagcataaaaaatgaacaagttcattttgttctgcgttcggtttgcactatctttgcccccgaaaaacgatatgtggagagatttgagtagcttgcaaccacagaaaaaaatgctaaaacacatccttttctgacggcacgtttgtgtgccggatgcatctactccacacacctccttccgccattcgttgaattatcaattatcaactatcaattatcaactgaaatgggatatttattcacatccgaatcggtgtctgaaggacaccccgacaaagtggccgatcaaatatcggacgctgtgcttgacaaactgttggcctacgaccccagttcgaaagtagcttgcgaaactctggttactaccggtcaggtagtgctggctggagaagtgaaaaccaaagcgtacgttgacatgcctctcatcgcacgcgaagtaatcaagaaaatcggctataccaaaggcgagtatatgttcgagagcaattcgtgcggcgtgctgagcgccatccacgagcagagccccgacatcaaccgcggcgtggagcgacaggaccccatggaacaaggtgccggagaccagggaatgatgttcggctacgccaccaacgaaacggagaattacatgccgctttcactggaccttgcacaccgcatcctgcaagtgctggcagatgtccgtcgcgaaggcaaggtgatgacctacctccgtcccgacgccaagagccaggtgaccatcgaatatgatgacaacggcacacccgtacgcatcgataccatcgtagtttccacccagcacgacgacttcgtacagcctgccgacgacagcgatgccgcccagctgaaggccgacgaggaaatgctcgcccaaatccgccgggatgtaatcgagattctgatgccgcgtgtcattgcttccatccatcatgaaaaggtgctggcactgttcaacgaccgtatcacatatcacgtcaaccccacgggcaagttcgtaatcggtggtccccacggtgacaccgggctgacgggacgcaagattatcgtagatacctacggcggcaagggtgcccacggcggcggcgctttctccggaaaggacccctctaaggtagaccgcagcgcagcttatgcagcccgccacattgccaagaatctggtagctgccggcgttgccgacgaaatgctggtacaggtaagttacgctatcggtgtggcacgccccatcaatatcttcgtagatacttatggccgcagccacgtcaatatgagcgacggtgagattgcccgtaaaattgacgagctgttcgaccttcgccccaaggcaatagaagaccgcctgaaactgcgcaaccccatctatcaagagactgccgcctacggacacatgggccgcgagccgcaggccatcgtcaagcatttccgtagccgctacgaaggcgacaaggacatagaggtagagctcttcacctgggaaaagctggactatgtggagaaggtaaaagccgccttcagcctatagcctcccctaattgtcaattatcaattatccattgaaaaagtaatcagcgtagctttacggctatttatatagaaggctgcccttctgctccgaagtatcgggacggaagtggcagcctttgatttccttaatttggctatccgagcaggaactcgctggcaggtatcattcggattgtcttcccgtcttcttcgaaacgatcggcctgattggtggtcacgatgacaccctccgtaaggttgagtgccttcatggcttccagcagtccgttgtattcgcgggtgaagttcagttcggttatctggtggcagacttggacggcgcggcacactttgcctttctcgctgactatgaagtcgcattcccccttgtctttatagtagcagatgctgcccggttgcctgcgcagatgcaggaagataaggttctccagcttatgcccggtagcgtccgagaagttggccgcagcttcgttcaccaaccctaagtccatggcatatacttttttcggattccgagcttgcaccttcagcgaataattgaagatgggcacgaactccagcagataggaactttgatagaacgagaagtaatccaagaaggtagacgttgcctttatatcgaacatcccggtcagtttccccgccgatacaaggttgcctacattggatagcaggtagacggcaagtgcgcgtagtgagttcacatcctttatcgaattgcgtatggcgatgtcccgtatcaggatgtcgtcaatcagtgtgttcaggataatctcggcatgatacttcacatattccgggatgcccccatcgtgcagataggccgaaagcgaatcttcaccggcaggcaggtttctgaacgacaagaactctgaataagagaagggaaaaagctccatcgggatgtgtcggccggtgaggtgggtgcccagttccctgctcagcaacgaggcgttggagccgctgatgaatatggtatattctgcattgagcatctgatggataaagatttcccatttggggataatctgtatctcgtcgaagaacagtacgcggatgccgcggcgttctatctcccgcaataggcgggtgaagtcatcggcatcgaagttggcaaggcggatgtcctcaaagttcaggtagagcgcctggtcgtacttccgggacatgagttgccgcaagagggtgctcttgccacaacggcggatgccggtgatgatggtggcaaacgaaggtactgccggtacgccggccagtgcctcgcgcgtcagtccgttttcttttttgcggaatatctcggcttgcgcatccaatatagccgatatttcttcttgtctgatcatcttgttaggggattgattcctgcaaatatacgaaatcgtttgttactaacaaatgatttcgtagtttaccagcaaacgaatattctatttgcaggagtcagaaggaggtgttcatagtcggggagttatcaggggaggtagaaggagttatcgccctttaactccttctacctcccccgataactcccttaaatgaaagagccgtgctttgtaagttataaattgaaatgaagtgacggcattctgtcttaaattatgtatttttgcagcagagacgacaataatactgatatatgagacaccttctatatattttctgcttttgttcaggccttgtctttctgtgtcattcttgcaggagggagattgcttctgtatatcctgcgcttctttctgccgattccatgatgtggagcaatcccgacagtgctttgctggtgttggaacagataccggattcccgcgagttgcggggagaagaacgcgccttgtatgcgttgctgctgacacaagcccgatacaagagttgtgtgctgctggagaacgattcgctgatacagatagcggtagactattacgacggaggcagaaagcaggaacggctggcgcaagcatacttctattggggatgtgtctatctggaaaataaagagtttccgaaggcgataagcctctatctgaagtcgctggaactgataccagagaaggactctatattcgtggcgatgctgtacacccatttagggagttgctatagtggacaaaaactgcgctctatcgcaagagacatgtataaaaaagggtatgccttttgtgtgggtaaagattctgcccgggcttgttatctcttgaatgatattggagatactttcttggtggaatatcaattggatagtgctttggtgtattatcggcaagtgttagaaatggcttctgctcttcagcgttccgatttgctatttgctatatgtagcgatatagctgctctctataatgaacaagacagatatgccgaagctgaattttatatatcgaaagcattgtcatatcaatcttccaaaaaagattatactttagcttgttctaccaaaggggatattttaggtgacttaaaccaaagcgattctgccatttattattggaagataggtgctgaatcctccaacatatatgtaaaggcatcgtcttatgactgcttgttccgggaatacaagaaaatgaaattatggaaggagtctactttgtatgctgattctttctttatctattatgattctatccaagcgatgaatgaccgtgcagagcttgataaactgatggataatcatctggtggagttgcataaacgcgagttgtctgccagaaatcaatggattattgtaggtttggttgccgcttttcttgttctggtagcgatattgattattctttatctgtggcgtgatggtcgtaggaaaaagaaatatgtagatttgcagcagcgattgatggagaaccgtgcggaagccatattcctgagtgaagttaccgaagcatcttccgatgacaggaatgcagaactggagaaattggaaaaagaacgttttcaaatttgtctgtctttgtttgaaacaacggcaggaagtaaaagactggatgaactgaagaaggccactccttcaatgcaaatcaagatagcagatacatacagagcattgattgtaagtaatatccggaaatcatttgccgatgtcatgggtaacctgaaagaacgttaccccaatttgacgaatgacgacctgctttattgtgtgttgtctctgcttcgttgccccaaagatgtcattctgcatatcaccaatgtttctgcagatgccataaaagtaaggaaaaaccgtattaagggcaaaattgatgctgagcagttctctcatatctttgattgttgataatcaatggcatatcttctcctttgttacttttgttacccgttgttgttacctttattacctcttttttctttgttagtataagaaagtaatcttcctttgtctcgaaaccattgaattaattaatatgaagacaagagaactactattgttatgtctattttcctttatttctatgagtgtaaatgcaggacaatatcaaaagaatgaaaggaaaataagattggaaaagcacgattctaaaaattctccggagaaagcaggacgttctactattccattcgaagtatttgcttatttgaattcggattacgaattaatatcagtagatttaaagagtactgctgatgttgaggtttcagttaccagcctttttactaatgaaaccattctttctgattcgtactctacttctacttctgagataatactaaatttagcaggtttattaaatgaaggagaagcttaccgtatagaaattactatcggagataccgtattatacggggattttacgtactaacactataattcaagaaaaaatgaagaaacatttgctgttcgcctttttgggcgcgctggcttgttgctcatgcagcaacagctacgatttattggagaacgatgcagagcttgccagggctgccgaggattatgaattgtcgaccagagccgccagcgctgaagctgattctgccaaaattgagacaatagccgacgaacaggccattcaggctacgatggatgagtatgaacagaaattgatgaacagattgtctgttgctaaagaaagggttatgcgtacagcttatgccgcaacaactgacgtagtaggagttttcaaggttggttcatgtggtacgtacaaagagttaactcttcatctagatgcagaagatactagacagaattctaaagtttcaggtccagtgggagatacatatgtggatggtaatggtaatgtgaattttaaattttgtttgactgaagcaaataggtattatccaggtggggtatttcttgttaatcatataaattattctcagtttggtggtacaatggatgttcttgttcgttatcatgattgtgatgataagcataataagaatagcataagtagtactgatacaagattttcgtcagttaaagatcttgctggttatacaatagtggatactaatgctgctttagcttgggcctatcctccttaccctcgtcctcaatggacaccaccttttggacttggtccaaaacaatctatcacatatggggttttattggatggtccagcatttactgatagaggaataatttatgttgatgatgaagattccagtaacaaaaattggttgaagcactataaaggatataaagaagatacttcaagtatatcatcgggtatgcatggaatagaaggaacagataatacaagatattatgttgtcttgaatacggataaggaggactttgtgttaagaaatctgtatcatcctaattttggaagagtccctctgccgtagcgatatgaagtatcttatttttttatatttcttttttctgtgctcttgttccaatcgggacaagagcattgtggcagaagtgaatggctatgaaatcagtgcttcagagttgtcccgactaactactcaggaaacttttgatttattgaatacagcttacgaaataaagttgaaagccttggacgatttgattaagcataaactgattgagcaggaagctgctgccgtggggaaaacgttcaatgtttttcttgatgattatgtaaaagagatgataaatggtaaagaagacagcctgcttatgatgttcggctcagtagatgaacgtgtcctccattcaagagaaaggcttagcaaagtgtcttcaggaagtattgaagggaatatttctttgagaaatgatataagggctgctgtaattcagcatttggcagattcactgtataataaagcagatataaaaagatatctttatcctcccaaacagcctcaatgtgttattagtgacttgaatgtacattatagagggaatcttaatgctgctaccacttttattgtagcgtccgactttgattgcaaacgttgtgttgactttgaaaagacgttgaaacagatttatagtgaatacaaggataaagtgagattcggctttattaatttcgccgatgagcctactcttgcatctttgtcatgtgaagctgccgtcaaatacaataaattctgggagtttcatgatgccatttttgaacatgaggctttggtcgattctgcgtttgtttttgctactgccagtagactgggtctggatgtcgaagaatataagcaagaactgctgtctgcggtgaattatgatagggtaaatcataccatcaacaaattgatggaacggggactatttgccactcctaccattatcattaatgacagattgatatatatcacaaattcttatgaagagctgactagactcttgaagcaggaattggaactgtaaaataaatcttggctattatggtgaggtatttcagtattatatggacgttgtgtctgctttttcttttgtcaggttgtgaggaggagtttgatgttgatattccagattctatgcttgatggaattgtttttaacggggtgataaccagtgagaatccaccttactttttccttttgagaaaacctgctttaatatcgggtcaagacggacaatacgaaggaatagaagatgctactatgatagtgactgattgtacggatggcattaaggacacaatgcaggtgcttcatccgtatgatgactatggtggggtcttttatgactattacgattattatcagaagaagtctgcacgtgtggcagtgaatcccgggcatgataatatttcttgccggggtatgtatgccactaccaagatttatggtatagaagggcattcttatcagttggatattttttatggaggaaaacattataagtctgatattcaaagaatggaatctgcattgcctattactgatatgaaattgaagcgttttgactttaacgagaaagggcatacatgggcaccttgtatcagttttatcaatccctttggagtagacaattactatctgtttcaattgaatgcaaatagttatacaaattattctcttaagcatcctcagtttctattaagtagtggccaattctggggatattctatcttgagcgatgagtatcttgaagagaatgtggttgattttctgattgacgacggagaaaatcctttgggttatcctccgggttgggattatcccatgggagattccctatatgtatgggcgcagaccatttccaggagttgttatgacgttttcgaccagatgatacgccagtttcggtcggatggtggtgcttatacgcctgcaccgtcatcggtgggcagcaatataagcggcagggcgtatggctgcttccgtgtgagtgcggtttctgaaaaaggcattgcaacgggggaaagatgatgtgttgttttgtaatcgtaagaagataaagctaatgaaacggtcgctgatttatttctgtattttgtttttgagctgtcaggcagtggttgcccaaaaggttgttgtacgagggtgtgtgacggatgccaaaacgggtgagattctttcggatgccaatgtgctggaacgaaggtcgggaacgggtatggcaaccaatgcttacggactttattccatatcacttcccaaaggggaatgtatattgcaatgttccatgttggggtatgttacttggagggataccttgactttatcaggaaacatggtggtgaatatcgcattgactcccgatgattattggctgaaaggtatcgagatagtgggaagccgcaagcatagcggacaatttgctttagaagcaaaggaaatacaagcattgccatctgtgggaggggaaccggacttgatgaagtcattgcagtttctgcccggagtgcagagtggcaatgaaggggcaaacaatatttctgtacggggcagtaaccaatggggaaatctggtcttgctggatgaggctgtagtttataaccccagccatgtattgtccttcttctcggtgttcaacaacgatgccatccgcgaggtgaacttgtacaaatcgtttttcccgttgaagtatggcgggcgttcttcatccgtcatagacgtgcgtatgcgcgaaggcaacagcaaggaacgtgaacggagtgccggcttggggctgatagcctcgaaagtgttgttggagggccctttgaagaagaaagaagggtcttatctggtttccggtcggtttggatatccgggggtagtagccggactgttgggaagtaatctgacatccaaaccgcagatgtggttttatgatgtcaatgccaaagtgaacagaacgctggatgctcggaaccggatgttcttttccttgtatagcggaggcgaccataccgtgttcaacaagctggtgaaaggctatgggatggattggggaaatgccacggctaccatacgttggaaccatatactgaatgataagacgaatgtgaatacgagtgctgtcttcagcaactattattataagtataaatcgttgtcggacggattgagatatgtgtggaagtcgaacatgcagtcgtatcagttgaagtcggattgggagaggtatcagaacaatctgctgaccttgaagggaggggtgaacctgcattatttcactacgatgcccggtgaggtgggcaagtctggtaaggattctaacatcactccttcgcaaatgccgcgcaagagtttgtgggatgcggcattgtatgcagaggcaaattataaatttctgccccattttcttctgaatgccggggtcaggctgtccgtactgcatgcaccggcctctgcctattatgcagccaagacatttgtgatgcccgaaccccgtgccgagctctcttttattccgaatgcctcgcaccggttttctgtatcgtatacacaagcggcacagagcatacacatgctcaccacctcttcggtaggtatcccctcggacatgtggatgcctgccaatgcactgttgaagccctccgtcatgcgccaactggcattgggatatgagtacaattttcctgataaggaatatacattgtcgctggaggcatatatgcgccggacaagccatgtggtggattatcggaaaaatgccgatatttttcagaatgaccggatagaggatgaagtcgaaaccggttctgccagagggtgtggattggaattctacttgtcaaagaataaaggagccgtgaccggatggattagttatactctctctcgtgcgcgtaaccgtataggaggagaggagtacagaccggtgtacgaccgtccccataacctgaaattgttcgtaaactgggaaatgaacagacattggtctctgtcttccactttctcctatgcatcggggatgaatcttacgcttcccattggcaagtatgaatcggaacatgtactggtctatatttattctgcccggaacggttatcgtgctccggctttccaccaattggacttttcggcgacgtggcgtatcaggcaagaccgcagtttgagcctttccatcatcaatgcttatagccggaaaaatgtgttctccatttatgcagggagacagggacacttttctgtaggaaacgggcgtatctataaactgtatctttatggcatcgtcccttcgctgacctattctttcaagttttgagataactcttatttttttcctccaccggcagtacaaacacgaaccttgccccctccttgtactccttgtccagcagcactttccctttcagccgttcggcgatgaggcggcagatattgagtcccagaccggtgccttgcccgaagctgtcggccttttcaaagcgttcgaagatggtctcggagtattccgggggaatgccggtaccggtatcggtgacggagaaggtgacgtatccgggattctctgtgagagagcagtgcaggcggatttcgccttgtgtggtgtgtttctctgcattggtaaggaagttgatgagtatctggcacacacgttgcccgtcggtgctcagttcgtagcagtcgtccacttcggaggtgtagtagagcttcacgccttcgggcttgcggtgttcaacggtggttatggcttcccggcagagcttgttgcaactgtgcggcgctatcttcatggtgtatctgttgctttccaactcggctgcgctgaggatgtcccccaccagtgtaaggaggaggtcggaattgtgctgtatgagatggcagaaatcctgcctttcctcttgggaaaggttcgcgtcgggggaagtgatgagttgtgagaagcccacgatagagttgagcggtgtccgtatttcgtgactcatgttctgcaggaagatgctctttgccttgttggctgcttcggcttggtcgcgcgcttcggaaagttcctcgttcttgtggcatagttcgaggttgactttacgtttgcggtggaggtagagcatcaggaaaagcagggataacagcaaaaagccggtgacaatgctgaaaagagtgatgcggtagcgcgaggtggcctgtatgttttccattttcagacgttcggcgcctatctgggtgttcagttcggcgatgtccgacagttgcaggagattgttcgtcgaatccaactgctggtggtattttttcagatatttgatggcattgggatagtctttggcgcattcgtaaatgtaggcatgttgttgcaagccttcctcggacaattggtcagcgtgggcatgggcctgctcatactgtttgtccagtatgttcttgctgatgtgggctatcagtagggaaacgctggcagagagcttgcaacggtccgccatttgtacggcttctttatagcagtcgttgaattcatctatacgtccctgccggaatagtaccaggcatttctctatcatggcttgggctatgttccgttctgttttggcgctcttcaaggctttttcgcaatagtccagtgcggtggcgtaatctttttgggtgttacggtaatattcggcaaggcttgagtatagttggctgggatcttggtcgggcatattcttcagcatatagtccaaggcttcctgatagtattgggcggagaggtcgaagtttccgcgtgatttgtagatatggcccatggttcggatacagctgaagataccgtaagggtatctgtcggcaaaagcttgctttttcattttttccgctttctgcaaggcgagcaatgagcgttgttggttcaggaagtagatgatttcgctgctccaagcgtgataataatattgcagatagttattggcacgtgaaatctctttcaggtcagtggatgccttttctattttgctatcatctttttgggatatatagaactgcagggggatgatgtatgccaggcattgtgcttttttgtcaccgagcttcagagcctgttgatacaaagtgtcggccaccagcaacccctcctgctggcgtgcctgcttggaagcccgctggtagatggggtagagtgcatcgtctatcttgtagggattgttctgtgctgcggaaggtaggaacacccatactgaaagcactagaaaacataaccttgaaagaatgcactccctctttgttctattggatggaataagcatgtttttttccggatacttattattatgcctatggcatcgcaaaaataagataaaagaataaattacaagctttttttgtataatttctctgtttgcttgttgaatgatccttgccaggagctttcttacgaaatttccggtgataatgccgccctctacatcatcatattcttccttatcgagaacttcacgatggccattgcattgactgccgccagcggcaggtccatggggtcgtggtggttgttgtagctcaccagacggatgcagtccggccgttccgagtggttgacgtatttcactgccaggtattcgtcgccgccccgttcgaaggagacgagatacatttcaccgtagatgacgtcggtgaagtcgcggatggacttaaagcctacgatgtcaccggacttgaggatgggatacatcgagtcgcccgagacgtagacggcaccgtcgcacacagggatattgggaattacaatccgccccaaggcgtactgcgggcggtcagccagcagtgtcttcaggttggcggcggcagagatgtcatagagggtcacgctacggtcgtccatagggtcggctgttttcggtgtgtgaagtatttccacttcaccttgtaccaagtcattgtcacagaattttgaatgatgtgcaggcgagccctttcccgtcagcagccagttgtagtccacgtcgtccaggctgcccagcagcagggggaagtcgatgctgttgcgggcgttccagttgctcagtgtggagcgtgatatacccagaaaggcggcaagttcgctgtctgtcttgaattctttcgccagtttggcacgttttatgatgtctgccgcacaaaataccgggtctttgtcattcgccatattcttcagtttttacgtgtaaattattcagaaactattatctcctcatttatactgtcttacgtcttatttaagaatttaattcccgatttgtttgttttataaatgaaaacagcattatctttgttgggacaaaaatacatatcatgttttataaatgcaaataaaagggagggatttatggaaaatacacatctggtcttttatccggaagcatccgaatttagcaaaaatacttacgaatttgaaaaaatgggcatccgccttgccggatgtatagatgaggtgcgttggaagtatagatacaacgcgctggatgtatagatagaatacgctggatatatacttccagcaaacagcccctacaagcatctttggcaggggcgtgccgaaaaaatattattgtactaattcttaacaaaaaatggttatagaacagattattgaaaaaaatgttcgtttctgtggatgttgccacagagaactgcccgttgattctttttatgtagacaagcgtacgcttgcccccgacaattattgcaaggaatgccgtagggcgatgagcaacgcccgctaccgtcgctcacttccagcaagcaatcccctccgttatccggtcatcactgaaatttcggactgtacccttcgtatgtatcttattctgaatgctttgaaggtagtgcgcgaaagcgtgctccgcaagcggaaacgcctatgcgaagcaggtgatatagaatgatacaagccgctctctccccctaatcactaacccctaatcatcaaaccatgtccagaatcaaaaaacggggacttgactatttccccttgaacacagacttcatgcacgaccgtctggtgcgccgcatcatgaaacgtgagggtgacggctcctttgccattctgctgggcgccctctcctgcatttatgccgacgaaggctattacgtgtgtgccgacgagcttttctacgaagacctttccgcctgcctctatgaaaagacggctgccgacgtgaagcgcattcttgccctggctgtggagtacggcattttcaatgccgcccttttcggcaaatacgccatcttgacttctgctgagatacagcggcaatatctgttcagtaccaagcgccggaaatcttccgccatagacacacgttattgtctggtggatgattctcagagcgatgacgaggccgcgccgactgccgccgggagagtgccgtctgccaatggaagcgtgccgtccgctgccgaaagtgcagcatttaagcccgaaaatgcgacatcgggtacatatagcacagcagagcatagcacatcacaacacagcaaagaaaatcccctcctccatagttcccccggaaccgggggcactgagggcgcggatgtgccatccgcggagggggaatatcttcggaaaatagagcaactgcaaccgccgcaggatggcacggaccgcaacctggacgggttgcttttcaatctgaagcagttccatattcctccgcaagagcagtatgccattatcctcaaaagtaatttcggtgctatcggccaccctttgtggaagggcttctatgccttgcgcgagagtcatggcaagatacggcaaccggggcgatacctgctgagcctgtgctgtaagtaaagttttcgatttgtgaataatttcatgaagaaaaacggtttttttaatttgcacacttttccggatagcgttatctttgcaatgtggttaagcttaatacacgaaaataaaacaatgttgtttcatttgaaaaaaacgaatccttgaatttcaagacaaactattaatttttaaaacaaaactactatgccagtaatttacaaatcatttcagtcggttcttgccaacaaagagggcaagaagcttttctatccccgcgtggtgctgacggggaatgtggacaccgagcaggtggctaaggagattgcggagttgtcttccctctctacgggtgactcgaagaatgtcatcgacaacctggtgaccgtgatgactcgccacctgcagtcttccgagagcgtgacgctggacggtctgggtactttccgccttacgatgaagtccaccatgaacggtgtggaagaccctctgaaggtgtcggctacccagtccacactacgagtgcgttttctgcccacctccaagcgtaatctggaccatacggtgtctacccgttcgctggtgaccggggtgaagtgcgtgcgcttcgaccttcaggacacggcaggttcgggcggcaacgacggtggctcgggcggtaacgacggtgaccaaggtgaaaatccgttgggataaggccatttacgatttgacgatttacgatgtacgattgaaattcgtactgctaaataaccgcgcctatgcaggcatttatgatacgaaaagtaatcgtacatcgtaaatcgtcaaatcataaattactaatcttcaatcattaatcactaactaatcttatgcgaaaaatcaactacatcgtggtgcattgcagcgccacgcgggagggctgtacgcttacttccgaggttctggaggcagagcaccgccgccgtggcttccgcacgacgggctatcactactatatccggagagacggtactgtgctcggaacccgttccttggaactgcccggtgcgcattgccgcggtcacaacaagtattcgataggtatctgctacgaaggcgggctggatgcccggggaaatccgaaggatacccgtacgccggagcagcgttcggccctgcacctgctggtgtaccagctgctacaacagttccggaacgcccgtgtatgcggccaccgcgacctcagtcccgatttggacggagatgggacggtggagccgtgggagtgggtgaagcagtgtccgtgcttcgaggtaagtaaagaattttaaaacaatcatccttaaaacatggaattatgaaaataagcaaagaaacctggaaagatatcttgaaaattgtgggcaccatcattgccaccatagccagtgtgctgggcgtgcaggcgatgccactgtaggaggctgaaaagccagcaagggaatgggagaggcttggaaaacagctcccccatcccttatcccgcaaaacatattgaataatttttctaataacaacgatttatcatgaaaagaatatccttgtttttattactgttccttttactgaaggcaacggttatgtattcgcaggatggccatcctgaaaccaacttccggattgttccggtatctcccaatgcagcttcattgggaactttcggcatgatacctaccgacaattatgtggggcaagccaatctgactatcccgatctacgagattgaccttgacggaaagaagttccccattgcactatcgtaccatacggacggaacacgtgttgcacaagaagctacttggatcggccttggatggaccctccaggcaggagggtgcgtcgtcagacaagtgcagggtacggacgactttgcagcacgtgggtgctataaccttactgatgctccgtggctgaccaatcccagatttgaagtgaccgaccagaatttggagaagtatatgggttatttcaaaggtgactatgatgccgaacctgatatgttttacttcaatgcaggcggacattcgggctccatgtatttcgacgtattgaagaacaaccgacaactgaatgccgtccctaccatccaaacacaagaaaaagtggtaaagatggtatacaatacaagtaacaaaacatggaccatgacggacttggaaggatatgtctattccttctcgacaaaagaaatcacatactatttcttaaataccattgatttttttcaaacagatataactagaagtcatatatttccatactataacgaaccgcagattgtaacagcctggatgcttgactctgtgacatctcccaacggtggaaagattatgtttagttacaaaaaagaaagtatttttactcccatttctactacagaagacgttatatctttgtctaaaatagtgaatggccaattgtcttcacaatctccgcagtatttcaccaataagttcaactacaattactcatactccaagatagagcaatggacattgtcggctattacttttgaagggggtaaagtagaattcggtacaactgatcgtgaggatatagagagtgcggaaaccggaaaaaaggtacagaagctgtcgagtatcaaggtgagtgatactgccggtaaccttatcaagaccaccatgctggagtataaatatctgcttagcggaatggctgccactaccaatggttatgatgaccgtttgttattgtcgaaggtatatgatgtggctggttcgaagaagaacaatgtatataccatggattacaatatggggaaattgccgcccaaacgctctctgtctgtagatgcctggggattctacaacggtgcgtcaccaatgactgcttctttaaagattagccccagcatttattggtcggagtcgataaagccgagcagtaagacgagcttgtttaaagaaggtatggaccgttcattcaatgaggcgttgtgcaagatagggacgctgcgcactatcacctatcctacgggtggcacaactacctttgagtatgaaggacatcgttttgaaactttgcctatgatgccccccttgcgcgaaggaacccttaacctggtagacaacggtatgccgcccgtagcacccggagctcctgtccttatgtatattggcgagccttttgaagtggacgatgccaatcccaagattatcatccgcagaagacatgacgaacctcatcccagtgaacatcttgcttcgtcgcttacttacacaacacaactcgaaaagaaagagggtaatggttatagaaccttgttctcttctcccgattatgatgtgatggagccctggcctgatgacactgaaaagcaactggacagaggtacgtatcgtgtgacattggcagtgcagaatgtaaggttggagtatcctatcaatatttcggtagagatagtaggcaaaacgaatgctcccttggataaggattacctgggtgccgggctgcgcatcaagtccatcacgaatacggacggcaacggtaaccagagttggcgtaagtttgaatatcaggatgcaaagctgatggtgaagccggtattcaacgcaccggtctatgtagaacaaatgcaaagttgggcaggaaactggatgaatgcttactatgaactgattcaatctgctccttatatccctttgacgaatctttccagaggaaaccttgtgggatatacggcggtcagtgaatcatatggcgacatggatactcagggatataccacttacagataccataacgttccggatgaggttactgatatatacctggccggtattcctacggtgcctgactatgagaacggtaaactttcgtcggtagaatatagggataaaaatcataaactgctgaagagagaggagtacacctactcaccttcttcttcggaagaggtttgggcaccgaaaatacgcaactattatttcaatccggattattcccatcctacccgtaccatgcagccttacaatctgtgggcacaatcgtactatctcagcaagaaagtgactaccgactatcgcgctgaaggcaatatagtggacgaagagagatatgcctatactgattatggggtactttcttctttaaagagtaacaagcatggggtggagaaagaaaagcagtttaaatatgcaaacagctttacagatgccgtttccgtcaagatgaaagggaaatatatggtgggtatgcctatagaacatgtcgaactctctgccggcaaagtggtgaatgcgtcgaagacggaatataaagatacgcttaatatgatattgcccaaacgtacgttgagattcaactctactactcccaagacgctggccgattatgcgggagcctatgtgcaggatatttggtttggcaagtacacttcgagaggccggctgctgggttatatacgcaacaatttgccggtgagcttcctatgggcctataacaatctttatccggtggccaagatagaaggaaagacgtatgaggctgtagagaaaatctcgtcggcgagcatcagccaactgccggccaatgcgaatactgcgtctattacagctgtcctgaacacagtgcgaaacgggcttgccaacgacaatgctttggttactacctatctctatcgcccgcttgtgggtgttacggaaattgtagaaccgaataaagagaaagcgacctttacctatgatgacttcaaccgcttgttccaggttaaggagcataatggaaaggtagtgaatgaatatcagtataattacaaaccccaatgaaacgaaagaactgtatgaaacgaaaatatatgtttatggcgttgttgtgttatgcattgacaacagcggcgcaggatgccagccataattatgtgcgtacccgtagcatgctggatgaaacgggaggtaaatatctggacaaggtggagtattttgatggcctgggacgtccgttccagacggtattgaagaaggtgacggcaagcagcagcaatctggtgacgttgcaggagtatgacgttgcaggacgtgccgcgaattcctggctgccgatagtctcgtctgccgagtatgtggcgcctgcttctttcaagagcagtgcgcccggcaactatggcaacgactcgcgtccttacggccagccggtgtacgaggcttctccgctgaaccgtaccgtcaaggaatacggaccgggagccgcatggcatggcgggcattccgtcaatacggactatctggccaacagtacggctaacgcgcagttgaactgcatcaactatagcgtaagcagtgcaggcgcactgacgagcaacggcagctatgcttccggccagctttcggtcgtcaagaccaccgatgaagacctgaacgtgagctacaccttcaccgacaagatgggacatgttgtattgtcccgtcagatgaaaggcagtgaaacgcacgacacttactatgtgtatgacgacaaaggcaacctctgctttgtgctccataatcgctatcttagcggtctaattataaacataagttatacccacccggcttagggtcgggtggtatataactgccatagttttttcttatctggtcctatcataggatacacctctctttcatacttttatatattttctatcgtgttttatatgattcattattttgataccatagcaaagcatccttttctagttgctttacaaatgcatccttaccagtgcagtagccttcaatatcctccgagaatcgataagccagctccatctttaattcaccatactctaaagcgatgtctggatgtgtacgcagaaagtcccttactgctatatgcctattaatatctttgtgattgctttgctcaaaaatatgaatctggtgtgtcctgttatcgccgcctttgcggaaatatctacgtccttcaataccaaactcacccatacactcataaccaatcgctacaaattctttgttatgcttatcaaccaaactaatatttgtcactacgggcattatatcaatgattgatttagcggctaaccctttgactgctgtactgccaatatggtaaacctccaccaatatatccttcaatatattctttatcttctgtgattcattttcatactctacttcccaaaaggggtcgtacggaactactcgtataaacaatataaaccctccaatctcattctcaacgaataatatttttagaaaaaagtctttatactttttaacaatggagccgccagccagaacagactatactgatcagcgactaccttaaatttaatgtttcagatttattttcttatctctaatttcataaactacatcagctacattttcgagtaagcgtttatcgtgggtgataaacacgatagttccggcatactccttcattagtatttccaaagcctctaaacttggtatgtcaaggaagttactgggttcatccattagtaggatgttatatctacccatgagcattttagctagcaacaattttataatttctccaccgcttaaaacagataagctttttccaatatcgttctgtttgaaccccatagatgctagcactgaacgaatttctgatatattgtaatcacaatcctcctgcataaactccatgacattctgattactgttgtacttgtaaccattctgtgcaaagtaacctatttttgccttaggtgaaatagaaattccttcttcatggtttaagatcatttggattaaagttgtttttccggttccattaccaccagttaacgccacttttgctcctagaggaatttgaaaagatgcattttcaaacagtgccttatccccaaatattttattaatttccgtaccgactatagggtatggattatggagctccaatgctttactttgcctgaaacgaattctgcgaatgtcttccggagcttctacatttcctaaggctgcaatcctgtgctctagggatttagcggcattatgcatctttttttccttacttcctattgatttttgatgagctaaacgccctccgccttcagtactttttttctttgaagcacctttcgccttctgttctattttacgagcctgttttcgcttttcctccgcagccctttccaatcgggcacgttccgcaataaattgttcgtattctgcagcttggctcttgcgttcttcctctttctgacgaagataatcagaatagtttccccaatactcagtgattttgccatctttcagttcccatattttatctactatttcatcaagaaaatagcggtcatggctaataactaacagtgcacctgtaaaatattttagctgtccaattagaaaatcaattccttcacggtctaaatggctcgtaggttcatccgctaaaataccatgaacctgtgccgataaggcctgtgctattttaagccttgtttcttcaccaccgctcatggtctgtatatctaattgctcaacaccgagcttgcctacaagtgcaaaatctttttccacctgcaaagttacttcgtccaactggggaatataggcaagttcacccagacgattcattttacatcctgggggagttaattctcctaaaagtaccctgagtaaagtgctttttccagcaccatttgctcctactaaaccaatacggtcataatcatatacttctaattcatttatatctaaaacatcgcgtcctttgaattccacacgaatatcttttgcttttaatatcaattccataacatttcctcctgtctataatcgcatgttttcttttgcttgtacgcagggaaaaccctgcgattttagcaggaagaattacatgaaaattaaatacataaatatggtccctcctatgaattttgttttaaatctaattttctaacctcagttatcatggggcaagctatggcaatgccaataattaaaacacctgatagtaaaaaccaatgatttacaccgattctatcagcaaagaacccagatagaattaacccaattggcatagcaagtgacatgatacttccggtcaaagaaaatacacgtcctaaatattcaggcttaattttctcctgaaaaagagctgtttgcacaccgctgtaaaacggaaccgaaagccccattattgcacagcagactacaaatatgaaaaatccactttggggaagtaatcctgaaatggttaagcttatccccatcataaaaatggatgccgttattaataagattcgcttttggtaattcccaaataaccctaataatagaccccctatcaacataccagaggcataagcaatctccgtaatagaaatatgcatcggtgtaccattaaaacattccatagtgattaaaggatataaagcatttatgggcatataaacaaacatatataatgttccaacgagtaataaagcaaataatcctttattttgccgtagtacagccattccttctttcatttctcttatgaaatttggttccaaactttgcactcgatcacccagcttaggtatacgtacaattgctaccgtaatagatgcaatcacagcacccaatacgtcgatggcaataatagcatttaaatcccaaacggagtataagagtgctgcaactgccggactaacaatatagcttatagactgcaaagactgactatagcctgcgcatttcgttagctgctcttctggtactaaaagtggtgtaaccgaattgagtgctggggtatgaaaagctgttccaatgctacggataaacaatactatcataaccatccagacaggtagctccatatagaatgcaacaatagctagcacggccccagctgctgcgataattaaatcagcaccaatcattatcttcttcctatcatgacgatccactaatacaccaatggctggtccaaagaccgcatagggtaaaaaacctacaagtgaagccatagacaagaccatcgcagatcctgttttttctgtaaggtaaaaaataatcgccatttgcaggatggcactagtgattaatgatactgcctgccctgcccatattgtataaaacttaagtttccaattgttgtatttttccatttatattatctcctaaattcttatttgtatcagcgtatattttaacacccttaattccgcaacactataatttaactttatttataagttcctgagcaacaataagttgcctaggattttgccgtgtcagatttttcacttatcttagtgttgcaattagaaaacaagcgaaaatcgtaacaaggcgctgcaaaggcgccaaataaaattcgaaaaactcacaccttttggaggaattttttcaatcatggagaaatttgactccatgctttcacccgttatcgactcaacactgggtcagagatgcagcagtatcttcggatatcagttcagcgagatagtccgttcgctgatgagcgtttatttctgtggcggctcatgcgtggaagatgtaacgtcacaactgatgcgccatctctcgtatcatcctacccttcgtacatgcagctctgataccatcctcagagccatcaaggaactgacacaggaaaacatctcctatacttccgaccaaggcaagacctatgatttcaatactgcagacaaactcaacacattgcttataaacgctttggtttctacaggcgagttgaaggaaattgaggaatacgatgttgactttgaccatcagttccttgaaacggagaagtatgatgcaaaaccgacctacaaaaagttcctcggctacaggcctggcgtatatgttatcggtgacaagatagtctatatcgagaacagcgatggtaacacgaatgtgcgttttcatcaggcagacacccataagagattcttcgctcttctggaatcccagaacatccgtgtaaatcgcttcagggcagactgcggttcctgctcgaaggaaatcgtcagtgagatagagaagcattgcaaacatttctacatccgtgccaaccgatgcagttcgctctacaatgacatctttgctctgagaggatggaagacggaggagattaacggcatccagttcgaactcaattccattctcgttgagaaatgggaaggcaagtgctatcgtcttgtcatccagagacaaagacgcaacagtggcgaccttgacctgtgggaaggcgaatacacttaccgttgtattctgaccaacgattacaagtcatcgacaagggacattgttgaattctacaatctgcgtggcggcaaggaacgtatctttgacgacatgaacaacggattcggttggagcaggctccccaagtcattcatggcggagaatactgtctttcttctgcttactgcattgatacacaatttctacaagaccatcatgagcaggcttgacaccaaggcttttgggctcaagaaaacgagtcgcataaaggcttttgtcttcagattcatctccgtacctgccaagtggatcatgactgcaaggcaatacgtgctgaatatctacacagagaaccgagcttatgcaaaacccttcaaaacagaattcggataagaatcctttctttccggtttgaatctgcgtattacctcaagtcgcatcgtggggtaaggggatggtggctacatattgatgttgtgctgttgctttttactgaaagctgctactaacgactcataaatctacccttaatcgtgtattggatgatagttgcggattttaggtttattatagttgcggtatcacaccgcaatacaatagttataaatattgaaataaaggtgcagtgagacgctgcacctcctaaagagaattgatgatgagattgttggcgttgtcaacgacagaggtgtccaatgaggagaggtatatctgtgtggttttctcggagtcatgccccaatgcctcgctgatagtagatacgggcacgttcttgctcttggctatgcttgcccaggagtggcgggctacgtaggtggtcaggggtacggacaggcctatcatttctccgattttcttcaactgcttggtgatacggctataggcattcttgtactgtctccagaatatggctccctctccttttgctatagggagcaggtagggagaatcatctgttttgtacttcgccactatctcctgcatggcaggttcccatttgatgtgcaactgttgtgaggtcttctgacggcggtaaatgagcgtactgccatgcagattgcttggtgtaagttgtgccatatcgatgaacgacatcccacgggtatagaaactgaacaggaacatatcccttgcaagctccaaacgggggttcagactcaagtccagctctttcagttgcttgatgatttccaaggggagtgcccgcttgacggtcttgtcgatgccggtatatacatgcttgaacggtgaggaagagatgaccagtccgtcatctacggcatgattgtagatggtgcgcaggttgcggatgtagaaagaggtggtgttgcggcacagtccgctgtctttcagccactgttcatagccttgtatcgttgtcccatcgacttcctccaatggcacatcgcctcctttcaggtaacgctggaggctgttgagggtggttttgtaccttgctaccatccgcttcttgccgatgcgtctcagtttttcgttcaactccagcgtatagccgataatgccatgtaattcttttccctcatggaagttgtcaacgacggtgtctgctgtatatgactgcccttccttgtccaaccgtgcaatgaccaacagcagtttcttcctgtcagcatccaatgtatctttcaaggaaagaagataggcttgacgttgtggagtgacggaagttggcaaaatgatgtttgaatggtccgcatcccactctgaggaatagattctgtactctgtatggatctgacgtgccacacgattgtgtatcacctgataatacaggcgaccctctttctcttgaacagatgatgttctgaactttaatttgatggatgccataatgctctgactttaacattgaaattgcaattattacctttatatataatataagtgacagacaaacaggtataggagggatggtgcctcaccgctcggcatacaacagctgatattccacccacctccgtttcctaatggatgccactgcttttcccctccatttgcaatagctcagatagagtggcaggatgtccctgtcgccacgttccaatcgggtgagcagggacgctttcgggtatcgtccattgcctaacaacttggctggtccaatctggtacgagagggtggcaagcagataagcatccctgccataacgggcatataggcgcaggtgccggaggaggtctgtccgtaacagcaaatctgcacgctgacgtgtcagtgttttcgggaaacgctctcccttctgtagctggtgaccatagcccacatagcccggtgtggtctttgggtcgtgccaaccctcgaagtgtttggtaatggctaccatccgttcaaacagtgccctgtcaatggtttggctttgacagggcacgctacagatggccaacatgctcaatagtacgatgatgtatcttctcattacattattttatataggaggtgcgatgtctcaccgcactctaatcaatatcactacatcatagtgcggaactgctgaatctctttaatcatggctttcacgtcctccccaacctgaacgaagttcttgtagaggatgcgctctcgctcttctttcgacttgaacttatagaacttagggagagggacatactccgattcctccttctttatttccgtcatatcgaagtcggtcttgcagtagaacttggatgtcttgaactcctcgctctcctggatgttcatgcttccgttcatcccggtcttggtgactacgaagtcacgggcggtctgtccacatatccaacctgtgggcatatcggagattttgcttgcaggcaccaggctgtccatattctcattgaggttgatggaggtcttgtcacggtcgatggtcacgccctttttgagttgcactactttaccgaagatgtcactcgacagccattcgagggtttccttggctcttgccgaaccgctcaccacattgcccacggtggtgatgattttctgcatacccaccttgccataatcggcttccaactgcggaagttcctgaaagccaagtgccacgctcaccttgttgcttcgggctgtgcctatcagtcggtctatcttgtggaaatacaaggtcggcaactcatcgacgatgatgctgacaggaacgttcttgccctgtcctgtattcaccctcgttacaaggcggttgagaatcaaggcattcagtgcaccgatgatgctctccatctcggggtcgttggcaatgagcagataacttggattcttcgggtcactgaccttcaggtcgaagtcatcgccgtccttgtggaatatccagtaagattccttggtggcgagacgggaggtatagacacgtagcgtgccaatcataccttccaactgctccatggctttgttggcaaaggcagtctggaacgggccaagcaagggggctacctcgttgtcggtctgaagtacctcgaagatggtctgataactctcattgaggaacgataggatatgtggcatgtcgctgtacttgcccaaccaataagcgggctgcacctccgcgcccgaatggtcgaacacccgtcctgtgggtatcagccttttcgtctttgggtcttcacgccgctcggcaatcagcatctttccgtccttgtcgtagggctccttgccgtagttgcagaagaaatagatgcaggcggcaaggaagttgacggcagaggtctggaagaactggtcgctgccaccgccgccttccttcttgcctttttgcagggattcaagcagggtctcggcggtctcgctcgctgcggcaaggttgttgatgtacttcaactggatggggttcacacggcgcgaatactccacatccacaaagttgatgatgttgaacttcatgccatggggcatcttgctgtccttggcattcttgttcttcaagtaatgatagtagagtttggtggcgagagtgggaaacttatagtcgtacaccaccatggcaaagcccttctcgctgtgctgcctgataaacggctcgatgatggagaaggtcttaccagaaccaggagtacccacaacccatgtgccacggaacggattgacgatgttcacccatcccttgcggaacttgcccttgtaataatagcgcatagggatgttcacgctgtacttgttctcctgcaactccctgcattgctcaaagctctcattctcgaagttgaagcggtctttcagcagcccttccttcaggaacttagagatattgtcgagggcgatatgcaccaatacgacaccgacgatggaagtgagcatatagagccaagtgttcaaacggagggtatagaaacagggcattatcgaatgaccgaacagccatacggactgcacaatcagcagcactcccgacagcagcggatagagcacctgcctgcgagcgtcaaactccagatgcttcttgttgcgcgttcccacacaggtgatacatatcagcaggaacgtagccaccttgctatacacgaggttgccgtcatggtaaatcatccaccgcttgatgcgagtgtggatatccgtcactacgccgcccaagaagtccaactgctccggctccagtgcgtaggcgaagaactccatcaggatggagacataaatcaccgccctgaatatcttgtaaaaaccctgtaactctttgctttcttccatttactttacgatgatgttgggtgataatgagaaaagatgaaggatgccacggtggacaccctccaatcctcttatgagttttattcgtagccgttgatggtcttctcagactctactgtccacggagaaatagttgcagatatgacctccaaggtgttgcgtacaggcttcaatgaatagctgtaggaatgacccgctttccacgtgtcgtttgtgaggaatacgaagttctccccattgctgagttgcaatgtcatgtctggcataacctgtgcaggaacataaagcgtatattccatgtggtcactttgtgggtcgccgaaataataggtcgtcaccgactcgtcactgcattctacctttccggtcttgatgttgaaagtaccgctgtcaaaataaccgacgaacgtgagtaggcttcctgcaaaatcattggtggtgaaaccgtattctggtgaggtatagaccttgatgatgacacgcaccatctgatgggtgaagttcaatgtaaggctcggattggcgtatgatgccgctccactggcaaacagaaaatcattgaccttctgctcactctgtacagctgcctccggcacttggaactctatgaggtcgttggtaggatttgccgtatagggatagtaggcattgaaggtgtgagtgtctgtgtccgtgaaaaacaccttgttggctgacacaaactgattcgtgccgccgcttcgggtgaacttcatattgttgatcatccctgtggaagagatgccaatcatatcattgagttcccactggttgtcaacggctcgtgtggaaacggcaggttgcagcatctccagattggtgaatacctgaagctgcttggttgatgtgctgtcggtcacgaccacagaacctccgccaccgggcaggtaaatctcattgacgatgtcttggtcacaggacgtgaggagcatggctccaagtcccaacattagaaacaaattctttttcatgctttttcttttttaattgttgtactttgatgatgatacgggtgatactcgatgtctgtatatgggctaatccataatcgtgatgatgggtctcgccttatgcggctgccacttgggagtctcctgtatggcaccgcttcccagtgagtaaagccatgccttggcggtcgcttgtccttctacctccgttgaagtccaataccaacagtcatcatcctcatcggggataggtgtgccgccgcatttcaggatgtatgggttgatgatgtccttggcatgatagagcagacgcatctgtgccacactggggatataggcactttgcccgtaacgccacatgtcgaagacacgctcagccaaaggcgacttcacatcggtcgtgccataaagggcaaaagtgttcttgttgccgtcgtaggcggtgaggtcacaggatgtgtcctgttccacaccgatactgtcagcaaaggcttcgggagcgatgtcccacagatagacggcatatccgtttccctccatttcttccctctgattgacgttgaacaccactgcaatggcttgcttgcacgattgctcgtaggtttcgtagggcatcaccttgccgtcagtggtcaagatatgggtgaccttcatggctgtgtcgggaaagtcctgatgctcgtcacaggcagtcagcaacaccgttgccgcaactgccaagattgaaaacagtttcttcatacgcatagtcattttacaggaagtttcacacccaggacaatacccgttctgaacaggtcttcacccttgatcatcacatcggtcttcacctgccagaagagcttccagccgtgtctgagtgtatagttttgctcatagccgaggtggatgccacccaagaacctgtcagtatcgctacctgccgatgctcctatgcgcatgttgccatggtggttgcgtcctcttgccacacagggcttataggcaaagccgaaaccataactgcggtagttgttccaaaaactctcaggacagacatgaccgcacgatgcgcactcgttccacttgatatatccgtttgcaaaatactcccacgcattgtggtacttcgtctcatactcgtaggacagcgtcacgtccagtcctcgctcatacaggcatccgaaccccaaggatatgcggtcgctattctgctgcgccattgccggagtcatgcttgccataaaacagatgacaacgagtaaggtatgcacaagccaattcctcactcctaattcctcattcctaattctcattattcctcctccaacagtatatggttaaacgaatcggcagacagcacatcctcatagtcgatgctgagcgagatggtgcgtccacttatctgtttttccgacagctcgatggtcagcaccttgtcgttggggaaggtcatcttcttcaccacaatcacgttgcgatagccatacttgaaggtcttcgcatcgtccaacacaagagatggggtcagttccactatctgcgcattggtagccttgctctgcttcttgtccgatagtttgatgcgcatctcgtcgatgtcgaagcggatgttggtcttgttctccacggagaagtcgatgaagaaatattcgcccacgctgtagatgttgttcaggcgcattaccatgcggtgcatcttcgtcgccacgttgcggtatttggcagacgatgaccatatctgacgtgcatacttggtcatgtcggcagtggacaggcttacagcgggattgttgtaggcattgcgctccgagcattctatttccttatcggttactgcctcctgcatcctcgtggtatagagcagtgcatactgcgtgcggtagcgttccgtcacgattgtcactatcgccaacacctcaccgtcggcatacacgttgtccttcggcttcaggcggatggtgttgttgatgggttggtcgcccaccaccttgtctgtggatatatcgacaaagcggatgggttcggaggcggtgatgacggtggtcacttggtcgttgaccgtcagctgctccatctccatgtaggtggtctgcgccttggctgaaagcacgctcagcgaaagcaatgcacagacattcattttctgaaaacaattcatattagttgattttttgatgtttatactctatgagccaccgttcccgacaattccgttgtcgggcagtgtctatttccttttctctttcccatttacaaggtaaacaaacgtcccatacttcagcttcactttgttcttcttgatagccttgctgatggcattgcttgtcttctggtaggcattggtcacggcttgcattccccattgcgagaaactgttgttcgctccactctggtcgatgttcatgttgctctgcatagcaccgctcgccacatctttcgtggtctcacggaactggctgccggggacatacagtccctccagtccgtccgtgtcataaagcgaaagcgaaacctttatcagctcgtcatccacaaggatggagttgatgctacccttcactcgctgcgaaccgaaaccgctcatggtggcatagaggtacgaccctttcttcaccacggtctcaccaatctcaatatcgtccaacagtctcagccgcaccctcgacccgtccgtagccttcacgtcctcgtcaatgatggccttgatgagctttggctcatgctcgttctgcgtcagggtgttgaaatagtccgaagtcaccttcaccttcttcaccacctcctgtgccttgtcctcctcgtccagtgccttcaccgccttgctgtcctcggcaatctgacctttcacctcaatctgctccttgggaggcccagcctgtgtggtatcctgggccacgggggcaactgccgcctgtcctctcagcctcgcttcggcgagtgccttgttgagtgcttcgagtgcttccgcttctcgcgccttggcatcggccacttcggctgcatcgtccttctcttctgcctgacggacgagttccgcaaggtcttcttctgtgtacttggattcatacgcttctttctcttcttcgttgtcacgctcaatgttatcaacagccgaatagtctgctatgcgaccatacgacttcgccatgttctcatacttgccaccgatgccgtcaccattcttaatctgcgctccgggcaggttggggttcagaaactcggtggtctgcaggttcttgtcctgcgtttccgccacctccgtattgaacatgtcaaagacaaaatagcctgtggcaatcaacgggatgtacacgatggctggcagcatgtacttcggctgacggaagtttatcttatctgttattctcatcgctgtctgattttgatgttactgacttgtctcgattctcctcgttggttcgatgcgtcacgggaggagtgatgcaatgggctgcattcatcatctgcttcatgcgcccttcctgccgctcgatggcacttgcagcctccgtccgatgaccgtaataccgcaccatcctgtagatgttgatgccgaagcacgtggcgacaaagccgaagacgatgacgagaaacagcgtcttgtgggcattggcaaagccttgcaccttagccgccgcacggtctatcctcgcggtcttggcaaacttgcgccctgccgccacctccttctcataccgcttcttgtacttggggtcgttcttgtcgggcatatcctcgcccacaagcatccgtctgattccttttacactcataccgctaggatattagaagtttgacttcgacttctgctcaatatccttgttgagcaaggttctccagttcgtgatgagcagtccatgaggattgttctccgtcctcggcacgcgcttcacctgtcccgccgtcaccaattcacgcatcagaatattgctccttcgctctatcctttgcctaccgtagtaggtgaactccatcttctccttgttgaacttgatgctgtcgcaaaagatgctgaacacggcactcgtacccatgatattgttgtaaaagcccttttccttcagcgtattgtactgcgccaaaccagtttcatcgaccaaatacatcgccttctccatcgaatagcggatgtacttgtcatcgggagcaagcgtaaagaagtaatggtggaacatctcgatatggctctttgcctccacatccagcgtttcctccatcgtggtgcggttcaccagtatgggcacgttgccgtccaatacatacaccttttgctgcgcgtccgtcaccatgcagcgcgccgtccagatgctcgacaccgagatgatgatgcagcccatgaggaacgcagagcagatgatgcccaccagcttgattttgttttctaagttcttgattaccatacgttactgcttgtttgaggtctgatttctcttcattctcacatattcacggtgcaggatggtgtatatgtccttctcaacttcttccaccagtttggcgtaatacttgatgcaagcctctacgtagatgccttcgtatttcagttggatccacacccaccagatgtcacgttcacgtctccgtcgatttctgtagattttggcacgatgcaagcgataactcaggtaatctaccataggcactacatactcgtcgttatcctcaaagccttctgccatctcctcatactgtgggtcgatgtagttgttttcggaattgaaaaactcttcctttgcacgcttgttggcaaacgccatgaatttctcatctttgagccaacgctcaatttcattttttgctttcatttttcttgatggttacttttatttgtttcaataggaggtgcggtgactcaccgcacactcacatgttatctcatcacggtcgccatggttcccgtagccgtcatcttggcttgttgtgccacgccctcgccgaagtttcgggttgagaaggcggtgtcgccctctggtatcatccatgccgcaaggtcgggcacgaggttcaggcatttcaacgccacgatgctcgctgccatcagatagcctgccgagaagaacgagttttgcagataggctgccatcgtctgctcactggcggtgatggccgtcaggttctctacctgtatgcagagcacaatatcaaacagcaacaggacgtagaaaccgacgaagtagagcatggctccgtagaaatgaactgtcaaataacgggttagccacttcgcccacgctccttcccacttgggcagcaacgaaaatgcccattgtattggaccgaatatagtgagcattccgagcaatatctgctgacagtatatcgtcgcccaccaaccgatgcggaacacgatcagggctatcagcatcactatcttgtcgatgcccaccacggcccctgccgtcagtgaggtgaaccacagtttgctggcatccttctccatgttggtcacttcgtccacgcccgtctgctccatcgtcgcctctatcaggttggggtctgatgtgcccttatgcgccacgtctgcctgtgcctggaggtcagtgtacatcgagtccctgacatataccaactgctgcacctcctcaaacttgtcggaaatttgggtcgcctctgcctcatagaggtcgtgggtgtaactgccgatgcaattgggaatataggatagaaaatccaatacgcaccagctgctgccgctgttggtcatgcctgtgtcagcaggtgggtaccaccaacagaggatgatgctcaccaccaagggcttgaacagtttcatcacgtccaacggttcgttcttcaccatcatcttgtaggccatgcttgccgccacgatgatagagaacagtgccgccaatgccatacacatttggaggatccaccagaacggcccttgtgagcctgtgaaggtggcatcggtcaggaactcgttggtctggaatatcacatcgtcaatctcctcttcgaggatgttgatgccgaaatcgctgagtatgttgtctgccatcagtgcctggttctattgttgataatctctttgataaactctatgcctttcggtgtccatgacagatagaagtggtagaagcagcgcatcctgcctgtgacatataccgcaatgcccttgtcctgaaggtcttcacgcagtttccacattccatattccttggtgatgatgccttcctctttgagggtcttcacaatcttgccgtagtaacttccgacatatttgtgaagctttgacattgaaactacctctaaatcagatggcatataatgctcatcaacgatgggtgtcctgccgataacgctgattcgcttcggcatccttgacatctccaactgccacttgccgtttttcctcttggcggcatagagacgtaactgtatttttgatattgattccatagctatttctttattttatgttctttcgataacaggaatgactcccacgctcttcagtttctcatagaggaagcggcgacctttctgtgtccatttggtgttcatgcgcacatcctccgtaccgtccttgtgtttaatgaggtaggtctcgctggtcacataaccgcagtccttgtagtcggcatacagaatccactgcttgccacgctgatactggatgttcatctccttcagacgtcggttgaagcggatggacgactcgccatagtcctgtgctatctgtgtgaccaggacactgctcttcgtggcaaggatgatgtcaaggtaactcaccttgtccttcatctccgtcacctcctgttgcaggtcatccaccttggatcccaactcaacgatgcgtgtcctttggtgttcacactcctgttcgacaagcagacgcttttgtcgttcttccttcagattgactgctaaccgtatcaggaagtctggctctgccaatgccttctcgatggtctgctgtgtcatataggcaccatgcttgcggatagaggggagcacctccgatgtcacccacttgcggaaacgtttggcttcgggtttgcgactgtcaaggatgacatcatacagtccgtcttcattgataaagtttgtaacctgttctcttccaagactatccgagatggggtactttgaaagtacatcatccgaaagtcgttgtaccaacttgctggtttttagtccaagaactcttgccacatcagccaaacagaacaagggttgctctggtgttcctgtggttcggactgctccaaattcctcgttgttgaaaatctgaatatcgttcatatctctatgctgttttgtgattatttcttctcttcccttatttctatctgttcacactttcttcaccctcaccgctgttggcatcatcgccgtcagtgcctgtcgagctcctcacgcccttcatgttttcctgccaacggctcttggcatcgctgatgatgctgcctttatgtactacacggtcgttggtggctgccaagagggcggtagtctggctttgggtgttgagctgcacaaggtatttcagtagtgtctcgttctgtgtcgtcaggtcggcatagatgctaagatactgccgctttctctgtgcattgggcatataggcatccttggtggctttcacggcacactggtacatattgtacagttcctcccaccgacgcttgtcgttgatggtgcctcctgtagggatgatatggtctatgttcgccttcatcttgtccaactgaccgttgatcttgctgctttcggcaagccaggcgaggtctatctgtcggtcggctacgttcaaggcttccacctcagcacgcttggtgagggcagagtctatcttctccgcatcatctacttggttgtagaggttgatgccggcaagagtgcggaaacctaacttgttcttctctgccgctgtcttcttatagttgttatgtaacagccaataatagaactcaggggtgagagaaccgccacctgtctccatcaccgttatctggttctgcttggaggagtcgtggttgtaggtcacgctctgggctgtggctttgatggtggttgctaccgccatgatgagtatcattgtcttcttcatgtccgttcttcttttgtttacaatccgtcaatagtcaagttttcctgccactttccatcggctgaaggcatcttccagtatctcttccttcgtcctcgtccgatacaccttctccttccaatagcccatgcgcagctgcacataccgccatgtctggaagtaggcttggttcagatgtttttctatcaggtccaacgaattgttgatattgtccaacaccatcagcaggtcggaagttgaacaggctgccgctcctgtggcatacaacacgaggtcgttgacgctatggtagagttggcttccttcgttgtatatgttgtcgatggctttcttgttgatgctgatgagcatcgtgtcagccagttcgatgtgtttccgcttgatgaccttatcattgaagtcctccaacaggttcttgtagtcactgatgcggtcgctcaccgtctggtaggtgctcttcacgttcagcaccgtgcgcaacgactggtacatcacatcgatgatgtcgaaggcccgggtgtatttgtccaaatccacattcagttccttgtatttgcccacctcttcactgctgtattcatgcagcagttgattgctgtactccaaagtgctgcgtgccagcaagaggctgcgctgcttcttgtggtcgttgatgtatgcttccaccgataccgcatcgaatccccattgcgccaaggctgtattggggaagagggtaatcagcaggagagctatgatgatggtatgtctcattctccgttcctccctcagttttcgttctcgttatcttcaccattccctctgttagggtctgcattctctctccatcgctcgtagcactcttcaatgagtgtccttctgcgaccttggtctgcgtcgattgaaggaagaatgtccttcagcacgtcaatgatgctgcgcttgtagtgcatcattttttctaatgataccaagtcggcgtaaatcttggtgatacggctatctacttcacgggctatctccagacggtcgctcgaccagagcaggtgtattacatcgtcattgtcggcggtctgggttgcctcgctcttggcatattctgtggtgatgctgcacgacgggaactcctgggctatctccgagatacggctgttcacctgcctcgtcttctcctcgtcagaggcattcgggtcaagggtcagcacatccaccacctgtgtgtcggtgtattccgaggtcagctcccacgatatttgcagtatcgcacggtgtatcttgatgccaaggaagtacttgggcttccttgcaatggacagtgtcgccttgaaggtgataatgccgttgatgttgggcatggtggcagttcggacgtaggtgtagccgttccacgaaccggcaccttgccacgtgagattgtaggctgacttcacatcctgcatgatggcagggatgcggtagtagtcatcggtggaggtggcattgtcgttagccgcctcgctcttggcattctgtatgtctgccaactgctgctgccatgtcgccaattccttcttcaggttgtctatcttcgtcttgttgacattatgttgctgccgcaaggcaggggcttcctccacagaggcattggctatctgcgtgagcaggttcctgttctctgtctccaactggcttatctgcgcctccaacagggctatcttgctattcgcctcacgttccttctcgtccagttccgataggtcgagattattttctgatacgcttgtcctcatggcgcattccttgctgtgggcattgagcgaaccgccgcactcacggcacttgtactgcgtgctgccctgtccgagggtgacaccgtccgaacaggtgacgctgatggtcacgctctccacgcccttcagtttggcggcatcggtggcttgatagtaacggcgtgcgtcactgccgatgtaatagacatagccctcctcgttgtcgttatactccgagagacgtgcctgcaactgacgcttgaaggtattcaagtccatgctgtaggagtcgaagacatcctcatacacctcttccacgttgttccagctcttggtaacgtgtatctcgtaggcgtaggccttcttggtctgcttgccgccacggctgatgatgtacgacgacatccaatagttcatcgtataggtgaagccgtcgctctgggcgttgagctgctgcacacggctgcggctccatccggcatggttctccgagttggccagtatctgctctcgctgcgtgctgttagggtagaagttggggtcggaggtgttgatacgataccaatggtcaccgttcagaatactgttgtcatcggtcggcggatagtagtcacagaggcttacgctgccttggtctcgtcgggcaatgtaccaacgctgtgtatagtagttgccctgcgtctcgctcagatagtctgtcatccacgaggtgatgttgtagttggagaggtcgaagagggctgccacgttgtcctcgccacccaccagactaaggagtgtgctgccgatgccgttctctgcctgttcatagaggtcatggtagttgtcatagatgtcgatgattttactcaccttgccattgaaaaggtcgttgaaggcactctgctgcaagagtgcgcctgatgccccgttgatacctgccgtcgccaacgatgctcccatattgtaaagcgtctcgatgtcggcggtgaggttctccacggtgaagttgccgggcacactggcgatgtcatccaacagctgctgccaatctacattgcctatctccgagagtttgaggatggcggctatctcttggttgatttccaagaactgaatgtcggcaaaggtcaagctactgttggtcacgacactctcaaactgcatacacagcgactttgtgtcggcgcatatcttcatcaggtaactgccccagtagagggcggtctgcggacttttcagcatcattcctgccaccgtccatatcttgggcataatcttgttcgccaccatattgtggatgcggcggtaatagtagttctccgtgctactgctccaaatgccgaggtcggtgaatgccttgcgctccaagaacttggcagcgaagatgccggcagtggcaacctctgcggcattgtagtgcttcaagatttcgcccacctgctcgttataatagctctctgccatagctccagcaccgaatgcggcagccatggcggcaacgatctgcttgtcgtagttcacgctgtaatactgcgcatgaacccttcccacgacaagtgtaagacacatatatattataataaggtataaacgtctcattgcttcactactttacgtttttactactttcagtttctactattccactactttactacttgtagtatttactattggtagtattcactactaatcgtatttactactaatcgtaaatactacccagccaccgttcccgaaagttttgctttcgggcatctgggctttacgtctattccgggatttccgtttccatcaatcagcccccgtgctcgccgtgtcagcggcgagtggctccatcgtccgtcaaattgagcacatgccccgcctcattgaccttctgcgcaaatgccaacgacttcccgatgccactggcatcccaatctctgcaataccgctcgatagcctcctgatgtctgcacttcagttcatgcttatagagtttcaatgcctccttctcagctcgctcggtggtgtaggtcatatagcactcgtgcggctcctccacaccatacactccgctcgtcgatccacgtcggataaacacctcacggaagaaacttcttccctccttgttatccaagcggttgacagtgaatatcttcttgcaatccacatccgtcaatcctaatatcgccttgatctcgtcgaatcgctcacgaaatttgctttggtcgagcagcatcaccacgtcggagttgttgatgatggcttccttcacgatgggactgccgatgatgtcctgtatctcctgtgtcactacgcccacgctcgcccagaactttcgggctgtcttgtataggtacttgatgtactcggccatcagcggcgaggcgatggctttccatgcctcctcgatgacaaggcacttgcggttcttcttcaggcgcatcttctgcaggaacacgtccatgatgatgagcgtcacgatggggaagagctgcttgttctccttgatggcatccacctcgaagacgatgaaggtctcgtcgaacaaggtgctatccacgttctcgttgagaatcttgtcgtacttgccgccacggtagaagttttggagcatataggcgaagttgtcgcagtcgatggtggtgatgttgttctcgatgcagatctggtcgagacgctcacaggcgaactcatagaatgagtcgaaggagagggtcttcacgctcaatgccatgcgccgttcctccagtcccttgatgagtttctccaccttgtcgtgtatctgcgtcagctccgtgccgcgccgcttctccatggtggagaggttttttctcagtgtctccttctgtgaggaaggatagggctgcacaccgttgaaatagaaatcgtaatactccgtcaccaactgctccacgacacggaactccagttcgggtatctgcgtctccgagcctttccatatcagcagtatcaggttcttcaggaagtctatcttctcaatgttcagctcccgcttgctgatgttgaaggggttcatggtgatgggcttgtcctccgtataggcgatgtacttgccgcccacatactcgcagagtccctcatacgagttacccgtatcgaccatgacgatgtcggtgttctgctcccacaactgacgcaccacgctgttcatgtggaacgacttgccgctgcccgaaggacccaaacaaaaaaagttcgagttgtcggtcagcttctcctttccctcctttcctgtgatgtcgatggctacgggcacaccttggcggtcggtatagtatatcttcagcggggtgtcctcattatgcacgatgcgctccttgtacatcagacaggtggcggcatcgccgagggtgaggaatcggtcgtagtcggcattcatgccatagcagttgccggggaaagagttgacgaacagctccaactggttgtaggcccgcttgctgatgtggatgcccatgcgcgagaaggagttttcgagatggttggtgcatttctgtatgtcggtgtcgccgctcactgccaccacgaggttgtagtgggtatagacgagctgcttgctctcacgggctatcacctcctgcacacgcttgatgtcctctacagccatcaggttgctggggttgggcatggaggcatggcggtttttcttcttgtcgagtagggcaagctcacgcttctggttgggcacgaacaccatctggttgaacaccacgcagtcggctccgggcacgctatcgacgatgctcacgagatcaacgggcatactggtgttgttcacctcgatatttgcgtagggacggatgaccgacggcaagttggcataatccacatccacaaggctatacaccttgcagctacggtcccccatgccgatggtctcgtcatcgaccttgaagttggtcatcgacaccaccttgtcacggaagttcatggagaagaaacggtccacatactcgcaggcttccgttttgccgaggaatcgggacttcacgccggcatccctcagctggtcgtgcaccttgcgtatcttcaccaagaagtcacgccatttcttgttgtcgaacgacatcagacggctcttcttgttctcctgtgtgatggtgaggtagcagacgctgtcggtaaagggtctgccgttgaaatagcggaagtaactctcgctcaggaactcatgatttccaccgttctcttccttgaatgccttcctcacaaacacgtcctgcttgtgcagcgcatagccttcgcccaaggtctgggcaagggcggcgaagaggtgggtgaactcatagtaggcctcgatgttggcggaatacttctgcacagggttctccatcttcagaacagcggagtattcgcccgtcttggtatagagcacgccgatgccatccacttcctcgatggagaagtagatgtcctggaagatgcgcttgcgcttccctcccgtgccgaatgccttgacactgatggccatgcccacgcagatggctgagaatatgagtatgatgtatagggtcattgttctttttcttttttaatcgcaaaaaggcgggcgcaccctcatgcgtgatgcccccacctccattcacttacaatcattgatagctttccacttggacataatggattctcttttttgttttacactttctttgaataggcatagatgaatatgccgttgtcactcttcttgctgtgcaagcccttgcgctgcttcatgacgatgagaacgccaccgacagctacggcgaggactagcagcacgagtcctgccacgaaaccgaagatgcagtagccgaggatgaaacccgcaacggctcctcctgcggtggctgccgcccagtagatgtagcgtccctgcaacccgaagaactccaatggacgttgcagtcccttgaaaatgggataatccggaaaacgctcttgctttgtatctgccataactgtcagtgttttaacgttctacatactcacaatctcacgctgcgtttaacctccaatgccgaagaacagaggcagtgcctgggctgctgcaatgaggaaaatacatgcgccgacgaccatcatgatcttctttttcacgtcctgttcctcgttgttcatggcgatgtaaacgcttatggctccgacaattgcaacgacacctgcaatggcatagcagagcttcaccacgataggtacatacttggcaatctcctccgtcactgtggtaagcgcggtcgttcctgccgagtagtcgccggctgcgttctgtgccattgctgcggtggtgccgacaagcaacatcagggcgagcgttttcatgcgctgtgaagagaagaatcccttcaccttcttgttaatcctttcaaacattctttttaccttttaatttgttacactttgagttatcttatctcgtatcacctgtatctcaaatctgataaccgaagaaagcggggaagacgatggtcgctcctatgaggaacaggcaggctcccaccagcatcatgatgttcttcttcactccttcttcgcccgtattcatctttatatatatctgcaaggcgctgactatgaccacgatgcccgccactgcatagcacagataaacgatatagagcatcatcgtcacggcatagtcatgggcactcgcaagtgcgtccgctccccagctgtagtccacgttgccacacttagcactggccagagctggggttaaagcggcatataatgatagaaatgcacttcttgtttttgacatcatatctcattattgagtgattccaccttgaccatgtcacgtccattgtgacgaagaccgcgggcgatgatggtgttgttcaattcttccgaatacatggggtcggaataggtggtattcacttcctccatcttcttctcgattgcgctttgtatcttttcaagcacatgaggcttgctctcttccgcagtggcggctgcctcctctgtaggctctgcaagctgcttctcctcgtaggctgtctcatattggttgtcgcctacgctgaaaccaccgtcgctctcgctgaccgctatcgactcttcctcgtcggtcatgtcactgacatcaaacgactcgccctgtgacttctcgtccttgggctttccgtacagatcctgcacgatgatgaccgtatagtagatgacatagattatggtcacgacaatggcgaatattacaaatgacttcatattttcaagtttgattttactatggtttggcttattgccgatgcaaaggaactaccttttcttcaatcttaaaccgaaatgactttccgcggagccaaatcttaactctaattttgattacactcgcaatcatactcaaaaatcaaactcgaaaggcacaaaaaaagcccttccgatagggaagagcttgtaaagagggtggatgaaaaaaatgtggatggctatatggtcaggtacttgccatgggagaagtcctgatgttcgttagagaaaacatagcccaactggttggacaagcattgggtgttgcctatcctggcatcgatgttggtgtgcgaatgtccgtatatccaatagtctatgccgctatcggtgatatagtcctccaactctacggtgaacgccacgtttgccttgctgccttgaaactttgggtggagcatacggaacgatggtacatgatgggtgacaacaatcttatgggctgcttgcgaatatgccactgcatccttgataaaggtgaggcaacgttcatgctcagcattgaattgggcatgggtcatcagctcacctttatataatatacggcggaagtcgcttatcacttgctcggtgaagtaagcgtcctccaaaggaatcctcgaccaaagggtggagaggatgatgtcggtgtcgccaatcctcgcaataccgttgtagtggctgaatacattgggacgtacctccaagagatagccgtcgggcagtgtcgccacatcataatatttgtagaactcatggttgcccatgcagcaatgcacctccttgtagttctccgatgcccagtcccaaaagggatgcttggagtagttgtcatcgccgagatagccgatgtcgccggcaagcagcagtatgtcgcccgtcacctccaaggggtgggctttcagataccgccaattgtcggcaaactccagatgcaggtcggatgcgtattgtatcttcatattggtcatgcttctataaacaattcatccagttgatctaacagtccggtcacaaatgcctcgtcttgaccgagtgactttgacaatggttctgcgagagttgaccagtcggctctgatggaggcgacaaactcccttatacatgccactattgaagcaggagcctcaatgttgtcctcagtcattatgaccacatttttcaggatgtccgaacggtgcttcttgatgtctttggtgttcacatgcttgccgtcccgcttgtctgccatgagatttaggtaggctcttgccttcagtgctatcaaggcagcggaattggcatggcgtatgccatcagtcagttggctgtgtgcgatagtaaagtgatagtaatcatcgtccatgatgatggcactaagactcgacacatcttcatcggtcgggataggttctatgacaaatccctttggctctccaagcacgtcggggtggcgtgacagcagttctatcatctcgggatagccgtctttaccatcaaggaaacgatacatttcataccttggtggctcaccagcctcctgtttcctcttttcaggtcgatagccagcctcccgcacaaactgccagaagcgattggcgaaagcctcggtcatgttctctacgatgactatcatgtcgatgtcgtgtgtggcgcgtggacgcaccacggtattggtcatggtgatgtcacaggctgctccgcctatcaccacatagttttctgagtattccgcaaatgcttcacggaacttgactaatccttccatttctgttcactgattattcgttctacttctttttctactctcggatcatcatcatctctcaacgaaaggacaagggaaaggcgatcaacccactggcttttgtcgcccattttgctgacaacagggtatttccatacctctatgatatagttgccgtcatagatgttgggattctccatgacatcagccgacttgacggcacgatattccttgcttgtcatcattatcatctcttcccggtcacgattaagcatggaataatgtgccagggcattgatgccgcatacggggtattccgcatccaagcgtatgtcatcgcaaaagatgcggttctccacaggtgacagcaagacgttctgagccttgtcccacagttccttgcccttcaactcgaagtgtaccaccttgctgcgctgtccgttctgaatcttttgacacagtcctacatcttcaagacaggtgacacccaacgtgacgctttcgtaagaatatggaagcaacggtgcaatatcccttggcgacattccttcaatactgcccacctgtaggtgatagagtagtatgtattgcgccacaggggtcaatacttcggcaatcttcctgttgcttgtcttctccaatgctatgatgcctggcagatgggcatattcctcggacatgacaaagaagactcctttgtctgccagtctgtgtcgctcgtaggtgggtccgggcgcaaggataaacaccgcaggcagtcccagggcttcggtcaaccgcttgcccgtgatggcgcaagtccgtggagagggattgcccttcttgggctcaacgaacagcaggggcgtgccttggtatgtgccatcatagaaacggtatgagagtttctcgccaaccgtgatgcctttcaggctttccttggcacgaggttccacctcaaagcgtctgcccaatatccttatttcttttttcaattccattctgctacattttaataatgtattaaaacgatgcaaaaataaggataataattgagaatcaagcatgtttgggcgaaaaagtgcagatttgatatgtaatttcaatgcatttgagccatttttgcatcaaatgatggtgttttcgtctttataatgtcattcagatgccgttcgtttcttcctcatcagatagtcgttgacatccttgtagtcggcatatctgaaggactcgtccgtcaccctgtactcgaatacattgctgatgctctcaaccgtcttgcgtcctgcctggtcgttgtcgaggaagcaatggatgtgggtgtaacggtcaaggtaatgcaatgcctgtttgaggttggcgactgagttcagtatcatatagtcgcaagggctttcaacgacaaaccatcggtcttgctgtttaacgagggtcatataagcaaggaagtccatgaagccctcaaagaccagacaaccgttttgccactcgttgaacgtatgggcaagcagggtgatgtccttatgcccgatgcagcccttgaaatagggattgcgcacctcatgtccttcactcagattgccaaaggcaatgccatagtaatgtttttgctcaaccttgtagtgtatctccctgcaatacatcctgccaatggtgatgtctatccgtcggctactgaaataggacagcagagaatggttgctcagtgggagcagcttcacatcgttcatcttggttgtcgtgtattccttggctgcgatagcggtctcgattgccttatccacagtggcaatactcttggacgcaaggtaggcaagggcatcggaaacggattgtttgttatacatacgctttaccagctccacaaggtcaccgccctccttaatggcgtagtcgtaccacaggttctccttcttgctgaccttgaacgatgcggtcttctcgtccctgaagggtgacagataccagtaggcattgcccttcttctttttcagcgttacattctccttgtctaagaagtctataatgctcagtttcttcgattgttcaatattcattgtactttcatttgttcggttttactttgtccatggaaacagtttactttaccctttctcctatataggcacacccgtaaactaaaccatttgctaaactacttttccgcttcccaattcagcctccgatttcggtttactttggccttatttcttatatataggtacggacgtaaactaaactggtttctgaactgtttttattcctcttcatggaacaggtcaatctcggcaggtgtatatccgaaatagtaatgattatcccgcttcactatgagcttttgctcgttaatcaggtatttcagcattttgatgatgacgcttctgccacgcttaaagccaatgtctgcataggcttgcgttaattcctccaccatgcgatcgaatcctttgataggtttctccttgaatgcagccgtcagcgcctcgttatgctgttcggatgtcaagtcttggtaagtaaaccttgacggttgcttgtcaccttcttccttctccggcgtgtgctcgacaatctctggcaacccttcctcattgactgtaaaggcaaacggcttgaactccttctcacggatgtgcatcgccttcacctcgctgatgtcgggattggtggtgctcttggtgatgacaagcaccgtctctgccttgttgttcatctccgtaccgatatgcccgcgcacgttattgtcgcccttgttctgatgcaatacgcaatggatgtgcaggtcatactttgatgaccattccatcatcttgttgatgacctcgaccgattctcccgcattgttgatgtcgagaagcaggtctctgattccgtcgatgatgaccagtccatagctttggtcttgggcaagcgcatagtctatgacctctatcctgacggagggcgtgtactctctcagacagataaagtcaaggttctcgttgtcgatgcttgtaggtagaccagcgagcttcaggatgcgctccagcacattatggcagtgatagcggctctgctccgtatctacatacagtatcttgcgtttcccctctggcagactggcgcgatagttcagtaccttgccgttggcgagggaagcggctaccaaggcagacacgttgaaggtctttttcgcctttgccttaccagtagaagcactgaagttgcccaatgtggctatgctggaattatcaacccatataatctgaggaggtgttttataagtatctgttgcctttatcaacgattcgctcaatatgcgattgagacgctgtactccttcctcttttgagttaggctgtacatgtttgttattttcttccattttcattctttcggattatcaatttctattttcgttaccattccaatgacctcttgtttgttttggagcagccacttgtcgatttcttctctattaaaatacagcatttttccccttggcttatagtgtggaacttcttttgcggctgtaagtttgtatagcaggctttcagaaacaccaatatacttacatgcttcgtcaaaccccaagacggttttggtctgcttgaccatcttctccaattcctcgattcgctctattagtttgtcaataggtcccaaagcctccaaactgtcttctattgcgacaattcgctcatagagtctaaaatgtctttcattcatgtgtcacgtaccttaattaaattgtttacagacagtagcacggttatattagccgtctattctttctttgtgtagatagtacatattcctctgcttctctttgaatctcgttcttcgatttgcccttggttccttgaagccattcatctatctcagatttgaggaacatgatgcgtttgcctctcttgtgaaacggtatttcccgattgcttgtccagcaatatatggtatgctctaccggatgtgttgggagataagcacataattcagcaaccgtaaaccatgtttcttctttttctgattgaacaagttcatatataccatcaatcttgtcttctaatgatgacagctttttcagtacccccgttatagcgttgggaatatcttcaaatcttatactattttcttccatgctaattattttttatgatttttgatgcaaagttatggggagactgtcactaaatagaaaaagtaacgtgatagtaaggcagtatcaaccaaactatcacgtttttactttcatttagcagaattattgtgatttattcctctcttaatatctgttcgatggatttgcagatggcatattgacttgctgtcatggaaacgtttcttcttatccttgaaagagaagaggaaagacaacttgaagttatgaatttctctgttccatcctttttgatactggttaagaagcgaccttctcccatgacatattgccaattattgtttatcaaatggtattgagccatagcgtcaaacagtacggctacattacgtacattctttacacggatagatgcgtccaagtcgcacttgaataggcgacacaactcgctacgcacatcactgttgtcggcaaaatcaaatatgtcgtgactttggacaagttctaccaacaaatccatctgtctgtctgacaattggcatcccaaagtgaggatggacgatttctttcgggtaaggattggcagaccagtacccacatgttgaagaaacaactcaataagttcctgcttggaataatcttcttttttcttgattattgacacacacttagagtctctaaacaaagtaccaataatgccaattgccatctgtcgcgagttcttacaacgtgcacaatcacagtcaatatattggtgactgcgctcaaatagttctatgaagtactctgtcttcatatgattcttttcagcttgaagataccaacttcttgcgatctcaaacaactcatacagttctctgtagaagtcttctgtacactccacatgtttgtggacacgcttgctctcttcaaaaagagagaagccaaaaaaggctgtcttttttcatttttatctgtttattgttataaatgtttggtttccacgaaaggttaaagtgccaaaacaatagcatcattacatagaatgttgaaaatgaaaggcactaaaaaccacctgtacaataaaggacttattgatacaagtggtcttctatactaagtgcttacaaatgataatcactattcatctatgtccaacttaaaagcttctgtagcttcatctttcttcttgtcaattacttttgcgtagatttgcgtggtttttacattggtatgccctaacattttgcttacggtatatatgtctgtaccgttagccaattgtaacgttgcataggtgtggcggaagcaatgaaaggtgatgtgcttggtaatccctgatgcttttacccaccgttccaaaggcctagatatccatgaagggtcaggcagtccggcaaacaccaacagttctccgtctttcttgcgctcaccgcaaagcttgtatgcctgtggcgatataggcatgtattcaacgcccttagtcttctgctgagtgaaattgagacggtacccaccattgtattcttcaacctctgaccatttaagcttttgaatatcgctatgtcgcattcctgtcagtgcagagaacaaggctgcccgttttagtatatcatcacacggagtctttgccaatatattaagttcttccagtgacagatactctcttcgagcactctgaaacatgatatttttagccttggcagcaatatcacaattcagatagccatccacgaaagcttgtttgagtgccgccttgaagatagagaagtacgtcgatgccgtattccttgaaatagttcctttcttagaaccaccctgcggtgcctttatcaagaaggaacggaatgcctcaatatacttcatgtcaatctgcgagaactgtatgtagtcacacttggcaaacattgacaacagtgtgtgcaatctgcgccagttgacaactatcgattctgacgcagtttcctctctttctttgattaacttctcaatatactccagaacattgcattttgagcgttcgctttgttctgccatttccatttgctggtcagtaaagagagccatgttgtcgtactctttttgacgcaggactcgaacgccatccgcataaaggcaagtttccatatcttgcttggatttacactgaataacgccattgtcatctcgcttgggcttgtactttattctaccagcaacggctcgctcgcttcgtcgtttatcccatataggggtagtaatagacctcctgagatattcacgcactcgtttgggtttgtcatttcccgtctcataaacaggataagcttcaagatagatgaaccactcatctctccactcacttttctttaatttgacggagactttagtataatctaatcttttcataatggttttatatctttataaagtttgtctattgattccttgtgagcatacacataattaccgatttgccgggtcggtattgagtattttcgtatatgagcatacacggtgctgtcatccagatgaaatttcttggaaatctcacctattgtatagcaatcctctggttccatgcggtacatggtaactggtttccttggcttggtgtcaagcggagactgtcttaacggaaacagattcattagttctcctttgcatacaagtcgtattcctttctctggctcaatgaaggaaatctttttcatgtagatgagcctataaatggttgagcggcttgcaccaaacatagcatacgcttccgttatgctgatatactctttagacttgggcatattgcttacaatcttgtccagttcaagttggcgtttttcttcatcatgcttacgcttccacgccaccttggagcatttgggtgaacaataccaggactccaaagtccttgcgaagaactcttctccgcacacaggacatttccgtactatcttatactttgctactgccataattcattcattttgtagttcttaatatctattcttctcatcatatctactttttcttacaggtacaaataaggtacagatgtttataataataacgcaaagatagcaatattattgtgtacggccaaaaacaagaaaagcgtgtaactcattgagctacacgctttccatttgatattgtattcttatttctctatgtgcttatttcactttctcaaaaacggttccctcctccggtaccgttgttccttccggagcataacccactaccaccatttcatctattttgctttcaatgggagcatacttaacctgtgtattgttttccgtcagacggaacatcacgggaactgtatattttacccgcacggcttctcctttttgtgtgccgggtttccatttgggcatggcactgattacgcgcacggcttctttgtccagttcggggtcaataccacgaagcactctcgcattggcgatgctgccgtctttttccaccacgaattgtacggttacccgtccttgtgtgcctttcttcatggctgcttccggatacttgatgttcttgctcaaatattccattagtaccggcatgcctccaccggggaattcgggcatatgttccactacttcgaaaataggattgtcgagagtatccttgtccactacctttcctttgtaagtcacagctttcgtgtcttgttccggttggggagctgcttgagggtcttgaacttccggtgctggttgttcggttttgggatctacggcctctatgacttccgttgcaatcttcttcgtggtacgcgccacggcttcgatgttgctgacaatcataagtaaggctgccaagggaaggaacatcagatatttggtccttcctatttcttttgttctctttttgttcatcattttgatgcgtttttttaaaggtaaaacattgaaactgttatagatagttgctgcagccttttgatgtgacaatcctagcagatggtactggtaggttttggagtcatagccgttctccaatacgcgggcatcggccatatattccagattggtgcggatttcccgtttcatgagccaggcaaagggattgcaccagcaaaaaatgcacaccagttcactgatgatgacatcaatggagtgccattgccgggcgtgtgtctgctcatgggtcaatatttcgttgaattcctcttccgtatgcgaggacggatggataaaaatccagtggaaaaaggagaaaggcccgtctgctttgggaagcagatgtatatttgtgttgcctatttgtaccttgcggcatcggcatgccaggtggatgatgcccgccagttgcatgatgaggcgtatcatcagcaatgccactattccccaataggcgatattggcatattctgaaaggatgcttttccagtcggtaggagccgcttcggtgcctattgtgagttccggtagcacaacgctagcatagaggtctgccatggccaccatcggttcctgctccgtaatccacgtttgtatgttcagcagaggtacggcggcagaaacggcaaagaaacagagcagtgcggttctgcgccagccgaaaaacgtgtctttgtagaagaacagccgatagaatgcgtaaaacagtactatcgctacattcactttcagaaaataggctaacatgtttactcctttcctttctctatcatgtctataatgtttttcaggtcattggccgaaatcttctggtctttggcgaagaacgaaaccatttccttataagaattttcaaagtagttgcgcacaaaaccgctcataaaggtacgtttgtattcgctttcgcgtataagcggggtatactggtaagtgttgcctacacgtgcggcacggatatactgcttgcgctccaggtttttcacaatagatgctacagttgtgtagggaggcgccggtttgggatatttggcaacaatgtcttttacgaagcaactgcccagttcccaaatgtacaacattgcttcttcttcttgtatcgttaacttttccatggataaagtatttaaatgaatttaatgcaaatctacgaatatttcgtaaactaacatcaaacagtgagttaattaatctaaatgctcctgctgtgtgtatattcttttgccggattgaaaagaacatggctgttgataatcttcttttggctaagattgtctatctttgcagaagaagcgaagactggcggcacctcagcataaaaaatgaacgggttcattttatcctgcattcggtttgcgctgtctttgttgcaatgaattcttttaccttaaataaagcagaatatgggaacagttaaatcgttgttgctgggaatgtgcttcgtattgggtgcatgcacaagccagacttctactgtgcaaaccacagagaagggaactcaatgggaatggcagaatggtaccattgttgtcaaaactcccgagcgtccggcaggacagaagagtgtattgggactgactactccgaagttggaggcagtccgtgtgggttttgttggtttggggatgcgtggccccggagcagtggagcgtttcacttatattccgggtacgcaggtagtggctctttgtgattatgaagaggcccgtgcagataaatgtcaggagctcttgaagaaggcatccatgcccaaagccgccgtctattccggtgacaaaggatacgaggaactctgcaaacgtgatgatatagatttggtttatgttgctgcagactggctgcatcacttccccgttgccaagtgtgcgttggagaatggaaagaatgtagcgatagaagtgccttcggccatgaatctgcaggaatgctgggatttgattaacttgagtgaatctacccgtaagcattgcttcattctggagaactgctgctatgactggttcgagatgaatacgctgaacatggcgcagcatggcgtgttcggtgaagttatccgtgcgcagggtgcttatatacataatttgagcccgttttgggaccattattggaagaatggagaaaatgacaagctgggctggcgtttggactacaacatgaagcatcgcggtgacgtgtatgccacccacggccttggtccggtggcgcaagcactggatattcaccgtggtgaccgtatggaaacgctggtagccatggataccaagtctgtggtaggcaaggagctggtagagaaaagaaccggtgaggagtgcaaggagttccgtaacggtgaccataccacgaccatgattcgtacagccaatggaaaggtgattgagattcagcacaatgtgatgacgccacagccttataaccgtttgtatcagcttacgggcaccaagggattcgccaacaaatatccggtagaagggtatgcgcttgacgctgaccagctgagtgcatcgggcgttcagcccaaagtggatgatttgaattcacacggtttcctgccggagacggagatggaggcactcgtggagaaataccagcatcccattttgaagaagtacggtgagatggcgaaggaagtaggaggtcatggtggcatggacttcgtgatggacagccgtctggtatattgcctgcagaacggtcttccgttggatatggatgtatacgatcttgccgagtggtgctgccttgcagaattgggagaactttccatggacaacggttgtgcggctgtggcattccctgatttcacccgtggtgaatggaatgtggtgaaaggctacaagcatgcgtatgcaagtccggaagaggaagcggctgctatggagaaggcaagggcatttactgctaaactgaaggagcagggagccaaggaatgggctgaaaagtaatggcggtatactgataaaacaaaaaaacagcaggtgataagcctgctgttttttgttttatcagtttgtcatttagtcactttcagcaactcttccttcatcttctccactcccggaaagccggtttgtctgaacgtggtgtttccttcgcggtctacaatcagataagtcggtaccccttctatcttgaatgcatccgataggtatttccattgggcatctgtcagacggaaatgttcgccgtggatgtcgggaatcatattctcccaggtcttcaagggagaggtttcgccggtgatgtacagatataggatatccttgtctttcagttcctccttcatgggggccatcgtcttgtttgccatacggcatggaccgcaccaagtggcccagaaatctactaacaatacttttcctttgaatttgctgatgatggaagtgaacaaatcttcgttgctgacgttggtgtccacttggttgatggtgtagcccgtctttttcttgttggcttcgagttgtgccagcagttcgtcattggcggcagtcagcatttcacggtatgcggcgggcatggcgacaacggtggccttttgctcgtcggtgagcggggtgaagttcttgataccccggtagagggtgacattacgggctatatcgaagaagatacctttgtcggttccccaggctttggccaattctccactccgttcgacattccttgaagccatttgtacatactggttggacaagactgcctgcggcacattcaatatactcatatcttcgtcggacacgtagttggcgggtactttccgggcaagttcctgatagtagttgtttgcttcctcccgtttgatgagattggcgtgtagggcagccgatgtcaagatgctggcaacggaagacagcatggcatttgtaatcagtttgttattgatagtcaaaagttgtcgggtagaagcactataaggcaacttgtctattgcttcttgtgtttcgtcggatatttgaagtacgtatgctttggctgcatcaatatccttgccagccagtgcagctatgttttgatagagcttgtcttgcatgtcgatgccgaggtggtttccgttcaattcttgtgccacggtttccagcggtccgttgatatataccatttctccatagggtttcccttcgctgtggaatttagacttgcgccgggaagcttcgcgtagattgacgtatatttctgttgtcttgccgggttccatgaagaactggagcatatgctctctacccaaatatatggtacatggggtagtgccgggcaatgttacttctttggtgaaactgccgtcaggctggatgtcgagtggtatgtccgtgatgtctcctttgacattctcccacacggcaatactgattggcattcccatattggggcgtgaatccaggagttttcctttcagcatggcttttccgtattggatgaccggttcgggaagttcggcattagggtcggctttgtgtactacggcgttctggggaagtgccagttccggcagtttcttgcttttcagttgtattccccagatgctgaatccgttttccaccttttcgccttcggtgaagtcgaaggaggtagcattgtcggataggggaggaaagaccagctggaattccgcttcgcccgattcgggcatccaaaattctttacctggtatgatgcctataccggaacgcagttggtaggtttctccgttattgtctgtcaggtagctgtcgggtgcaatctgtatccagtacttgggacgatacttggcatagatgtggagcacggttgccgtgtcactgatgactactttactcacttcgatggaagtcgtgtttcttacgataaacggtggttggtcaatcacacggtttttggcttgcagggtacagcagatgcacagtaggaagcctgctaagagtaaatgaatgtgtctcatataaattgttttttgcgaaattacgaatgtttcgtaaagaaacaagcatgtgggagttaattgatgtaaaatacttccatttcttcgtttttcaaagaaaccttgtatctttgccatctgatacttaacacttaatatcttgtcatatgagaaccagaattcttttgatgggcttgttgttggccgctgttgccaatgcccagactatctatcatgatgcttccgccttcccccttctgggcaaagcaacagaatctacccttacccgctatgagcgtctgccggactctctgcagaacatctcccgcaagccattgtgggacttaggccgcaacagtgccggactcgccgtgcgcttccgttccaactctacaagcatttctgccaaatgggaagtaaggaacaatatgagtatgaaccacatgacaccgaccggcattaaaggcctcgacctctactgcttgcaagacggtaagtggatatttgccggtagcggacgtccgcagggcaaaatcaataaggcgactatcgtaagcaatatgttgcccgaggagcgcgaataccttttgtacctttctttatatgatggggttacctcgctttccatcggcgtggattctttatccgccattaccccgccggcagtagacttgccgaaacgtgagaagccggtggtattctatggtaccagcatcttgcagggaggctgcgcttcccgtcccggcatggcgcataccaatattctggaacgttggctcaatcgtgagtgcatcaatctgggatttagcggcaatgccttgctcgacctggagattgccgatgtcatagccggtgtggacgcttctatgtttgtcctcgactttgtgcccaatgctaccgtggagcaaatgagagagcgtgccgataaattctataccactatccgcagcaagcatcccgatacgcctgtccttttcgtggaagaccctctctttacccactctccttttgacaccaggattgccaaggaggtaaaggacaagaatgagacattgaatgcctttttccgttctttgaagcaacgtggagagaaaaacatctatttccttgcttcccgtgacatcatcggccacgacggggaggctacagtagacggcattcattttaccgatttgggctttatgaggtatgctgagatactttacccgatattggagaaacacatgcgaccgtaattaggtattacagccccgtttgtctgtttgctgccttgccgatgctgtagggcaactatttgtttcctttaacaaaacagtctgtttcctataagggaacagactgtttcaatatggcgaacaaactgtttttatatattggaacaaattgttctgatacgctgaaacaaagtgttcaaacgcatgtgaacactttgtttcgtaggcttggaacaatgtgttacgcttctatactcttatgcttcttatactcttcaatcacatgtttcctgctctgcaatatctgccagcgatataccaggcacgtggtgatgaagtagaagcccgtttgtatccatagtgcttggtactcgaaagagacttcattgagtgtggctcccatgctgttgatgcgtacgtagccgttgatgccgaaggtagaagggaagatgtacgagaagtacttccagaaagcgggcatagcagctcccggccatgaaatgccggagaggaacagcagcggcacggaggtgaacacgaacagcagcatgcacgtttcgcggttgcggatggcaatggatgctgtcatggcaaagaaaatacaagcggccaggtagggcagggtgaacagagtcaggacaccgggtatcgctatttggttgaggctgaaaagccatggaaccacacacagtatatataccgataccagtgaatataccatgaagtagctcagcccttttcccatcacaatgcgtagtgtgccgttgtagtggcggttgataggcaccaggtcgcggaagcggttctgttcgcgtgccgtcccggcagacaagccgatgccgagtagcagcgtttgctggataatcaataccaatactgccggaatcaggaaagcggcaaatccgttggttggattatagagggcgacatcctcatactctatcgggtaggcggtaatctcgtcctggcggtcggtggtattggcgcttcgctccactttgatgtctgcgttcatggcaagcgacacgttggtgttggcagtcagcaaggctttgtaatacagcagtccgctcatgtcgcagaagatgctgacctgcgtttgcttaccgcgtacaatgtcgtcgctgaaggtggaggggatgtagataataccgtatgccctgcggtccttcaacatcagtttggcttcttccatatcagcgcagtagctcacgaggctcacttcgggactggagtccactttccgcaggtattcgcggctcaacgaggagcgtgagtcatccaccacgacagtgggcacttcgtggatagtttcgttggtatagatgaaagcgtatatcaacggatagaccaacggaacgagcacgaagaagatgagcacgccctggtcgcggaaggtggtgccgaattcccgtttccatatatagaacaagtcatgaatgccttgtatcactttctgtctgaacgtcaggtctttcattagggcatgtatttatagtaaaccaacgctcctttcagcctatgggctataaggaacgggagcatcatgaaaataagcagcgctacgtagttgacccacgagtaaatcatggggtatccattcagtgcctggtccacataaatcaggaaatagtggcgcagggggaacagatttgccaatgcctgcaatacggggtgcatgcccatggcggggaatgacaatccgcacatggagaaagagagtacgccccatagggaagcgaaactgagtcccagacgcagggtaggcagggttcctatcatcaatattcccatgccttgcgatgccagcaccaggcaaagagtggcaagcagcatcggcaggatgccgctgttgcagggaaaatggaggaaaccgtagaggtatacattatataatattcccatcaggaagaagatggcggtatgcggcagcagtttgccggcaagggaaatccagatggagttgttgcccatgcgcagccattcgcgggcggtgcggtcttttatctcgactccgatggaatagacggttaccatgaagataagcagcatcaatacgcccggtgcaaaggtgttgcacagatatacggagtagttcagccacgggttattgagtggatgcgtatctatgacgatgggttggaggaaggccatcgcttgttcctcggtagctcctttggcatatagggtgctacgtgctgcggcaccggatgccaattcgctcatcatcttcatgtccttgaagaggagtgaacctgcgatgagcagggtattgtttgtatagaaagagagtttgggctgccgtccggcctgcgctttggcagaggtaccttcgggaatgtagaagaaaccgtaaatctctccgcgctgcatggcggtacgggcttcgttgatggtagggtagcgggcgacgacggctgtctgctcaaaagcgtccaagttacgtatcagctggcgtgaagtggcactcatgtcttggtccaccacacctacgggcatgtccgtaggaagcccggagtccatcagcgtggtgaagaatatgtagcagaacaacggtgctatcaccatacagaacagatagagcgggcgggaaacaagacggcggcattcgcgtcttgctacattccacaaagccgtatgtttcttatttctttccatcatcctctccaataactcataactcctttacttcttcaatacaacactcattcccggacgcagtccttccaccttctcttgcggagcggcttttacttcgaatgttttcaggtcgaactggccggtagtcttggtcgctttccaggcggcatatgtgccgaggtctttcatatagtacactttcaggcggatattcttatcgagtgcagggatgaacgcctcgaattcggtattcatacccaacccttgcagcaagtcctcgcgtacattgaaggttatccacatatcgtccagaatggcgatgttcataatgggagcacccgtgcccacgagctcgcctactttggggaatatctcggatacctcaccggcagtctgtgcaatcaggtaagtttccttgatgtacgattcaacttcggccacagctcctttggcacgttccaccaaggcagcggcagcggctttgtcctcgcgttccgcaccgttcttggccatatcatactgggctttggcggctttctccgtagcccgggctgcattgcgttgggcggtaacttcgtcaagcttttgtgtagacatcacgccttggtcgtgcaggttcttcacacgcgtgtaggatttttcggcaatctccagtccggccagtgccttttgccacatttcataggcagcttgtatctgttcccgacgggcgccttttagagctttttcgttctgggcttgggctgccgattcggcggcgcgtgcttgttccagtttggcctgcacgtccggagcctccaaaatggcaagggtgtctccggcttgtacgctttgtccctcttttacacgaaattccagaatacgtcccggcactttgctcgatactcgatactccgttacttctgcttgtccttgcacaatttccggccctttacgcaacatgaagaaacctacaagggcaacgatggcaatcactcccgtcagcgtgaggaatgccaacaacatgttactgttttgtgattttgtatccaacatattatttactatttgactgtttactatttacgattgaagaaactatcaattatcaattgtcaattcccccgttgcctttctcagatagatttccgtcagttttacgtcaatctgtgcgtctatcttttccgattgggcagaaagccatgcggtgtgcgcttcgagcacattgctggcaggtataacgccttcctcaaagccaagtgtggcgtatctcaggttctcgttggctttttccaggttcttttcggccatggtcagtttcttggcagcttcgttcacttggaaagccgactggttgacctgcagctctatcttttctttggcgtcatccaactggtattgggcgatgcgtgcttccgatttggctgcttttactttatagatgccttcgccccagtgccagatgggtaccgacaccatgacacccacattccacatccccttgaactttttctcgaaactgttgaagacggaagggttggttgccatatagctgcccattagtgctatggaaggaagatattccgaacgggtgacatttactttctgcttataaatctgcgtggcaagttccaggctacgcacttcgggacgggtagcataaacattgttgatgtcgatggcaccgttttccggagtagtgggagccaggtcttccttctgttcgtctgtgagcatgacgggagtggaaaggtcgagaccacacaattggcacagcagcatccgggcaaggctcaggccatcggttactttggtcagggtcatttcggcctcattcacttttactttgatggagagtccgtctgctttggtggcaacgccttcggcaatcattttgtcaacgtcgctgtcgagcttctgcagtagtttcagataaccttctgccagcttctttttatgggcaagggacactacctgccaatatgcctggtctgtactcaggattacttcctgcataccggtgttgtgctgctggcgggccagctcttcggcgtatttggtaattttgttgtaggcacgtatcttgccgcccatatataggggttgggtcaaggtcagtgcgcccgcatacatgttgcgggtgtctgtacgaaaggcgtcaaccaaggattggcctgcaccgtcgagggcacctaccaggctttgtcctaaagccagcaattggcctgccagttctggatgaagctgtgcgatgacttgggcagcctgctgtaacggtccgctgagacttgtacccaatccggacaaggctcctttctgagcgtcgctgaggatggacaactctttttgactgcgcatatatccgccgctggccgaaatgttgggaaggtaattagtaaatgccgctttcttttgatagtgggcagcgttgattttttcctggcttatcagcagttctttgttgttggagattgccaatgcacggcaactatccaagcttaatgcttcctgggccttcatggggaaggataggtatgccaaacagatgaaacagaagaactttttcattgggctatacattaattaaggtgatgaatctgttgtttatacagcaacaataattgcataaacaacgatgcaaatgtataggctttcaatgatattgcaaaataatttagatttttttgtattaattcaagctgaatgattgcgaaccgataagggtaccgtcagcaaaaatgtctacgcggtaggtgcctgcatagaggtattcttctacatcccaatatacggtgacggcttgctcttctccgttgtattctatatacttcttgatggaatataccagttcccggttctcgtatgggaaggtgttcgaggaacttttggtcagcacgtcattgtccggtttggtgatgcggatgtagagggtacgttcgccggtctctgcagtgatgtttttcacgatggagaagtttattttgaacttcacgatgtctttcaccttcttggcagtcttgccgcgtttgtttgtgggctgcacagagatgttggtggcgtccagttgggcggcaagtgtcacggtcttggtcaggttcttcttctcttcggacaagttgctgatttgccgggaagcggcgttgtacttcttggtgacatcggctatgatttccttctgttgagcagtcaggcggtttagcgagtcaatctggttgatatagcctatcatgactttgcggagagaggccagttccttcttcagacggcgtatctcggtggcattgctgctcttcacggtgcggagttcttccaataaacgttgggtcttcaattgttcctgctccaagagtacggagagggagtcgttggagactgtcaacttcagttcgtcatattgtctggcgaagtctgtgtattgattttcaaggtcttctttatccagattgaattccatcaccagttccttgttggtttgcttttcggaaatcagcagaatggtaactcctattaataataagataaggaggctgcctgccacgatgagaagtgtattcttcttaactgccatttttgataatgattaatggttaagtgattaatggttggtggctgattattcgtcctacattcattaatcgtccgcaaaattaatcattaatcattaatcatcgtccactaatcattggctaaatgtgtatttaactaaaattattacggaaatatttctctaattacgaagttcgctgtacttttgcgtcatctttaaagaacacttataaacaaaaaactttagaaattatgtcaaaagtaaccgtagtaggtgcaggtaacgtaggtgctacatgcgctaatgtgttagcctttaatgaagtggctgacgaagtggtaatgctggacgtgaaagaaggcgtttcagaaggtaaggcaatggatatgatgcagactgctcaactgctgggcttcgacaccactgttgtaggttgtaccaacgattatgagaagactgccaactccgacgttgtagtgattacttccggtattccccgtaaaccgggtatgactcgtgaagaattgatcggtgttaatgcaggtatcgttaagtcggttgcacagaacatcttgaaatattctccgaatgctatccttgtggttatctccaacccgatggataccatgacttatctgtcattgaagtctctgggcttgccgaagaaccgtatcatcggtatgggtggtgctttggatagctctcgtttcaaatatttcttgtctcaggctttgggctgcaacgccaacgaagtggaaggcatggttatcggtggtcacggtgatactaccatgattccgttggctcgtctggctacttacaaaggacagccggtaagcacactgctgagcgaagaaaaactgaacgaagtggtagcttctactatggtaggtggtgctacactgactaagttgctgggtacttctgcatggtatgctccgggtgcggcaggcgcttatgtcgttgagtctatcatccacaaccagaagaagatgattccttgttcagtatatctggaaggagaatacggtgaatcagacatctgtatcggtgttcccgtaatccttggcaagaacggtatcgagaaaatcgttgaactggaactgactgctgacgaaaaagctaaatttgctgccagcgctgctgccgttcacaagacaaatgccgctttgaaggaagtaggtgctctctaattgagggtaacttaaaatgataagcaaacctcacggtctttttccgaaaggaaaagtcgtgaggtttttttattctccaaaaacaagaatcattatgaaaaaactactattaggtattgctgccgcttgcctggctggttttacttttgcgcaggatgctccgctgtggatgcgtcatagtgtcatctctcccgatgggaccaccattgcttttacgtataaaggagacatctatacggtgccggttgccggtggacgtgccatgcagataactaccaatcccgcatatgatacggctccggtatggagtccggacagtaagcggattgcttttgcttcggaccgtatgggaagcctggacgtctacattgtggccaaagacggaggcgaaccacgacggctgactacccactcgggaagcgaaacgccgcttgcttttacagatgccggacatgtcttgttttctgcgggcatcatgccgtctgccgaggctgttgtctttccctctaacgggcagttcaaccaggtctatcgagtatcagtggagggagggcgcccgacgatgatttcgtccatgcctatggagtgcatctccatcaataaggagggagcgatgttgtatcaagataagaaaggttacgaggactactggcgtaaacatcacgtatcgcccattgcccgtgacatctggatgtatactccgggaaaagaaccgcagtaccgccagctgaccactttcggaggagaagaccgtgaaccggtttgggctcctgatggaaaaacattctactatctgagtgaggaaaacggctctttcaatatctaccgacgtactcccggagatgcgaaggccgtgcagttgacgcactataccaaaaatccggtacgctatctcagtgccgctacggacggaaggttgtgctatggatttgatggtgagatttacaccctgcttcccggtggagaagcgcaaaaggtgaacatcagcattgtttccgacagaaacgacaaggatattatccgccagattaagagtagcggtgccacggaaatggcagtgtctccggatggtaaggaagtggctttcgttttgcgcggcgatgtctacgtcacttcagtggaatataagactacgaagcagataacgaatacttcttgtcaggaacgtaccgtagactttgcccccgatgggcggacactggtttatgcttccgagcgtggcgggctttggcaactttacacttcgacgattgtgcgtaaggatgaaaagctgtttacctatgccacagcgctgaaggaagaacgcttgataaactcggatgccgcttctttccaaccccaatacagccctgacggtaaagagattgcctttctcgaaaaccgcagcaccatccgtgtcatcaatttgaagacaaaggatgtgcgtaccgttatggatggcaagtatcaatactcttattcggacggtgaccagtggtttcagtggagtccggacagcaaatggattctttcggactatatcggtgtaggtggatggaacaacaaagatgttgtgctgctgaatgccgatggcaagggtgaaatggtgaacctgaccgagagcggatacaacgatggcaatgccaaatgggtattgggtggaaaagccatgatttggaccagtgaccgtgcggggtatcgcagccacggcagttggggagccgaagacgatacttatatcatgttctttgatgctgaagcatacgaccgttttttgatgaacaaggaagaaaccgctttactcgaggaagcggagaaggcggagaaggaaaaagccgggaagaaagacgaaaaggatgccaagaagaaaaaaggggatgccgacaaagataaggagaaaaaggtagagccgttaaagttcgacctcgcaaaccgctttgaccgtattgtacgcctgaccgtcaactcctcgcatatggcagatgccatgctttctgctaaaggggataaactctattatctttctgttttcgaggatgggtacgatctttgggaacacaatctgaaagagaatgttacaaaagttcttttgaagaaagtaggtgcaggcgctttgcagcctgacaaggaagggaagaatatcttcctttgtgcccgcgacggaatgaagaagatagagattgaaggcagcaagatttctccaattgaatttgaggctttcttcgattaccgcccttatggtgagcgtgaatatatcttcgaccacatctggcagcaggtaaatgataagttctatgtggcagacttgcaaggtacggactggaatggatacaaagaaacttataagcgcttcttgccgtatatcaacaataactacgattttgcggaaatgctgagtgagatgctgggtgaattgaacggttctcatacgggagcgcgttattatgcttcgggcgcagcacttcctacggctgctttgggagtgttctatgatgaagcttatgcgggcgatggactgaagattaaagaaattatagctcagagtccattgacgaagaaaaagacggatgtcaagcctggctgtattatcgagaaagtggatggtgttgccattaaggctggcgctgattatttcccgttactcgaaggtaaggcaggccgcaaggtgattctctcggtctatgatcctgttaccggaaagcggtttgaagaaaccttgaagcccatatcttacggtgcccagaatgagctgttgtataagcgctgggtggaaaactgccgcaagaaggtggatgaatattctggcggacgcattgcttatattcacatcaaaggtatggatagtccgagcttccgtaagatttactccgatttgttgagcgaaagcagtcgtaagaaagaggctgttgtggtggatacccgccataacggaggcgggtggctgcacgaacaagtagcgacgttacttagcggcaaggagtatgaacgctttgtgccgcgtggccagtacatcggcagcgatccttttgacagatggctgaaaccttcgtgtatgctggtttgcgaggataattacagcaatgcccacggtactcctttcgtatataagacgttgagaataggcaagctggtaggtgctcccgtggcaggaaccatgactgctgtctggtgggaaagccagatcgatccaagtattgtattcggtattccgcaggtaggctgcatggatatgcagggcaactatctggagaaccgcacgttgcagcctgatatcctggtctataatgaaccggaagctgttttgaagggagaagatgcacagctgaaagcggcggtggaccacttgctgaaggggttgccgcaaaagaaatagatggattggactttataaacaagaggctgaattcaagattgaattcagcctcttgtttataaagtcgatggggtgtcttatttattttacagttacttctgacagttttaaccaaccagaattagtgaaggttcccttggcagagatatccagccccttaacattgcttccattgcctttggttgtatcgactaaagctactgcccaggtataggttcctttttttaccccgtgaagtttgggagtgaactcataggaagtgggatagccttttatccagacggataaatcagtattgttgtccagataagagtagactacttgattgtcttggttcaataatgcgaaagctactttatacttttggttccattgtggtatattggttgggcaatatccccagcctaagttgttccagcgatgtactatctttattcttgaaccactcttcatttctttgggaactacaatggaatcgggatataaacgataacctccttcggagatgaaacgctcaaccaaaggataggcatcacggaaccaactcatggtttcgtctcctacacggaaatccatcatgttgacatgagcttcctgaccgtcttcaaattctccgatacgcacatctttggctgttttgtaaccgctcgggtcattgtgataagggtgcttgctcacaatccatccaccttccagtagaaccgggcgtttcataatccaaggtttcacatagtttcgctcccactggccgtaatactctctcattccgaaagcatcatgacgtaaggaaaagcctttctcgcaagcgctgtccaacaagcgtttactatcgggatcaaaattctcctcacctgcccagtctttgcctgcacccatccaacgatggtagttgataactaaaggtactttggtgaagtgtttgacgtagaggtctgtaatccaattgaacacagcttcccggttcttggggtcaatgtacttcatagtgtgtgcctcaccccatttgccaagaccgtagccgtctataaattccaccaggtcagggtcattgtatttttgggcaaatgcttctatgaactttgcatatttctcctggaagatagggtcatcaggatagggagagcgttttccattgtctgtatagtatttggctcctgcatcgaatacataggccggagtggcttcattttttcggtcgcggctgtcgacaactacacggaaagagagacgcatacctctgtcgagtgccccttgaattacttttttcaacttttcgttggtatcccagccgtagactccttcggcgggattgaaggtactccaatgcgtacggatatagagtgtgcgtgcataatcggagattttcacggttgttcctttttccggtacatagatatggtcgtatttcttccagaagtcatcgctgacattctcatttgcataaacaacccaaccacttaaagggtttccctgcatggtttttctgtctggccagatttttatataatcagcttccgtatctacagccatcttgtatatctggcatcctgctgcaagaaacgcaccgacaccgtaaacttctgtcatgtcacgcgtcactttacgggggtcggcaccgataggctgtacccagccaagtttaccgcttgcatctacagcatcggtcagtgccttccagccttttataatgactggcatgaaatcgtcttcattcaagagtcccgcatttacgccataggccaacgcatatacaaagaaaccggtggaactggtttcgggagaaggataagaagccggatccagaaggctggcatgccaataaccgtcttcgttctgcaatccggcgatacgtgtgcataaccggataaacagttcttcgtaataagcgcgttccatcaagcctttgggcaactcctgcaatacttctgccagaccggccagtacccaggcatttccacgtccccagaacacctttttgccattggcttcttttttaccgaaataatgccaatcgcggtagaaaaggttctcttccttatcgaataggtattcgtaggtagcccggtattcattgtccatgaattggaggtatttccggttgttggtttcacggtatagcttggcataaaccgggggggccataaacaaggcatcacaccaggtccagcgttctagggttttgttgtcaccatactccagtttgaatgtaccgttggatggatggttgacaatccattccgtacgtgccagggtaggagccagtatttcctcttttttatatttacggtataagtcaatgaatgattgggaaacggttatatcgtctgcatggtacaaccgctgatggggttgccagcagtttcgtcttcctattttatagagccattgatagtaggtgctgtcattgtactcctcttctgccagtttagcccaatctaccatacctacataaagtgctccattggtccaatccaggtcgtggtgttcgtgggcagtgttaggattggaaatttgccagtctgccacttgcttcattttctcttttacttcctttttgctgaatggcacttgtgccatgattgccatactgataaacagaaaggctgctgctgttaattgtctgtgtatcttcatgattgtttattgataaaattaagggaattgcctttgttctcaatggacgcggacaattccctttatgagaatcttgaaaactatctttttacctttattcgtgttttattttgtctttgtgctgttaatatccttcgttttgcgggaattctgcacccgtatttgaatcgattatgctctgaggaatcggccataatgtgtggtaatcacgcataacgggccccgattctgtattgtatttgcgggtacgctccaataatttgccggtacggcataaggtaaagcggcgtgattcttcacctaccaactcgcggatacgttcgtccagcaagaagtccatggtcatttcactgtccgtaatttcaggagcatgtgcgcgacggcgtacaacattgattgcttcgcgggcacctgaaatatcgttcaaccccaaccttgcttcgcagagtaagagataagtctcggacaaacggaacttcatgcggtcacggtaggaaccggtcaaagaaaggttttcggaacggccatagaagaattttgtcagagccggataaagacggaaggtggtaaaccatgtttcgtctgtaatcgtggcttttttaccataaaggtcgggcatgttctcgttgttgtaataccagttacgtttgatgttgtattcggaattacgaatgtcttcttcatcaaagaaaccggtatcttctccaatccaccatttcattggtaccaattgcgacaagccgcggccacccagtgagtctgccaaaacaaaaccggtaatttcgaagtatttgggttcccaggcacggcgtgtccagtcatcggaatttgtaccgccaccagtagtgttatattcaaactgcatgacccaaatgctttccatattgccggatgtgcgattttgattgttttcaacgaataggtcggagaacacatcgccgtttgcttttaccttttcaccgaagcggtcttccatcaagtggaaatatccgctgttgatgacattctctgcggcagtttcagcctttgcataatcaccctgcatcaagtaaacctcacttagtaagtgttctgccgcccatttggtcagcttgccgacttttacggcatcagggtcagtaggcaggttctcgacagcaaactgaaggtcttctaccatgtgggcaataacctcttccttcggtgtacgggtaaaatcgattctgaactgatcttgaatcttgtctacataaggaacgtctccatacagataaaccaatgtacggtatgcataggcgcggaaaaaacgtgattctgcctgatagagcgccttgtctgtgctattatcccagttcgtgtttatttccgagtatttcaacatctcattggctcctgcaatcaggctataagcccagttccagtaggaacccacaataccggtatttggagttaatgtcaaaaaaccgaacggttggatagaaccgtctttagtgcccatggtagcaaggtcagtggcaatctgcaatgcttcgtaagggcaagcggcattgtgcatgaaggcaccgttttcaccccaagtgttgtattcagagcgtgcttcggcataaagtccggtagaacctacttcgaaaccataggaacttgtatatgtgttgtccggagccagttcacttttcagtttctcatccagaaagtcagagcaaccggtagcagacagagctactaacagagctagagttgcttttgatatataatttttcattgtatatatatttaagtaagtttagaatgataagttcagtccaagtacgtaggaacgtgcagtcgggtaagaggcaaaccaactgttgtcatagttcaatacgctgcgtatatcacagaatgtataaggattctccacactgatattgactcccaaaccgctcagtcccaatttctttacaaaattcttttcaaaattgtatcctaaagtgatattctttatttggatgtatgtaaagtctttgtaatagctgtgtccgtcgaagttgttatatgctggagaagcatatttggaattggtgtgttccggtgtccagtaatcggcattatgcagatagttgtataggttgtaactccaacttccgatattggcttcgttcaactcacgtgtaactttgaaggttccattcaggaggaatgacaagtaaaagttcttgtaagtcaatgtattgctcatagacatgaggaagcttggattctttgaaccgatgataactttgtcattggagtcaatataaccgtttccgtctgcatctttcactttggcagaacctggtttggcacctttttggatctctttttctgtaccgtctgctgcggtataggtgaatttgtcaccttcctgccagatgccgtcgacgtcatagtcgtagtaaactcgcaagggtttgccgatgaaccatttattggtgatatcatcttttttgtcaccacgtaggtctacaatcttgtcacggttcagtgaaaagatgattccggtgctccattcgaagtccttattacgtatgttgacggtgttcaaggtaaattcaacacctttattgcgtgttttacccacattatcccaaatggttttatagccgttcatgataggaacagtacgtttcatcagcaagtcttttgtgttggcgacatacatttcaatgttaccgttgatacggccgttgaagaatgaatagtcgataccgacgttgaatgtttgggttgtttcccactttagattcggatttccgacaccgtcgttggccagataagcaccgttgacacctgctccaccgtcaccccagatatagtttgtgaggtgcagacggtccaatgtctgataggggttgatggcttggttaccgttagaaccataagatacgcggagcttcaattggtccagccagttttgtgcattttccataaaactttcggaagcaatgttccatgcagcagccactgacgggaagaatgcatacttgttgtttgcaccgaaggcagaatagccgtcggaacgtccggtcagggtcaacatatattttcctgcatatgaataattcaagcgaagcatataagacagcatcgaggtttctgataaaccagaacttacggttttattcttttcacctgcattgatgttatgataactggaatcatcgtttacaaaactttcggcacttgacttggaagtctttttctgagtttgttgtacactgaacaaacctgtagcgtcgaaacggtgcttgccaaattcacgattatatttgagcagattttcccaagtgtaatcccagtagtgttcattgttgatgctggcttttccgctggctgttctaccgtctttggtgtcacggccatagtatgtgccggtaaagtcgctacgatagttgtaaccaaaggttgtacgggctgaaagaccttttactggcaacagaatgtcagcataggtgttgatgaagaagttacgtcttgtttgatcttggtcggcattgacattggccatcgggttaataatcagggattggtccataggttcttcataatacttgccgttttcatctttgtagataccataaggactttgctttacagcatgttcaatattcggggttataccaccgccatctctttgaataaattgggtctgtataccaatagtcagccatttgtttaatacttgtgtgacattcaaattgatattgtaacgtttcatagcagaattgtagactacaccttcttgatccagataggaaactgcccccatataagtggtgctttcagtacctccggaaatgcctacttgatgttccatggtaaatgcattgcggaaaatatagtcctgccagtcgtttgtaacgcctttcttgtaatttataagttcgctggcactcagaatattctcaggagccaattggtctccgctccatccatctttcaggcgtgcaatgtcttgtttaaatgtgatgtattcgtctggagtcatcacatcaatagtctgttggggttgcgacattctgaactgccctttgtatgtaacttggggtgcacctttcttgcctttctttgattgaatcaagataacaccattggaaccgcgtgagccgtagatagctgctgcggaagcatctttcaagacactaaggctttcgatgatgtttgggtcaatatcactcaaagaaccgttgtaaggaataccgtccaatacgatgagcggtgcattgtcagcacttaatgagttttcaccacgtacacggagggtttggtctgcacccggtttcgcatcaccagtagttacgcttaagcccggaatttgtcctgcgagacggtccatcaagttactgctatttatcatgttcagtttcttctggtctactgataccagacctccagtcaggtcggacttacgctgtgtaccatagccgattaccacgacttctgccagtgttttactgtcttccactaactttacggtactgtttctaccagcttttacagtctgtgtcacataaccgatataggagattttgagattactccctgccggtgcgttgattgtgtattttccgtcaagatctgtaatgacaccagtactggttccttccaccatgacatttgctccgataatcggttcaccactttcgtcaattactgtaccagagatgttctgtggttgtccggatattgccttgttattctttccggtatataaaataatgtgtgttgcgtcgatttcaaatttaacattagtccctttcaataaggctgctattgtcttattaatagtttcattcttaacattcaggctgactttctgtttgatgtctatttgctgcgattcatagaagaaagtgtatccgctttgcttttccacttttggcatagcctctgataatgggatatttgtgaacttcagtgtgatcagtttctctttcttttgtgcagaaaccggggcacatagaagtaccagtataagaatgatgagttgttttcttatatccataattgtcttaaatttaaagattaatgtaggtgtttacttttcgttaattattaaataatgtgcatttctcatttgtttggcataagtttttaattttgttactgtttcattttactttttgttttgtgtctgcaaacgaaattgtcaactcattctcttcgttaaaggtatatttcataggttggatgcgtgccatgatgcggagtatttcgtccagcggttcgctacgcaacgtaaacgtatagaaatatttattggataatgtaggatccacgtctatctttacccgataccatttagaaagcagtttgcaaatgtctcccaatgaacggtttctgaatacgagttgtgtatttgcccacgaagaggcaaaatgtacatcatctttttctaccttaagtgtaagggttttccgattaaaagtagctgtttcgcccggtttgaggaaacggttctctgtctcggtttccaaagagacggacccttctaccaaactcaccaatgtattttccgaaccggggaatgcatcgacattgaatttggttccgtgaactacgatacgcataccttctgtctgcacaataaaaggtttgtcagcatcgtgtgctacatcgaagtaagcttcaccagttacatttacgatacgctcatccttattcatttgtgatccgtattgcaaagaggtctctgtatgcatccatacttcgcttccgtcaggaaggagaaccttagacttacccgacaaattagagtataactgcggcatggcttcaggctgtccgttaaggaatcctatgtagaatgagcaaccgatggcaacagctatacatgcagctactgcgtagcggtatatctgtttcagttcgaagcgtttctttgcaggtttttcagtctgcttaggctcgctggcgtgcatacggttgacaagttcattccaataatattcggtattgggcgtgtagttttctacatttgcctgaattttttcccataacagttgcaattccttgaataacgcttcgttgttactgctgcgtaaccaagtctccaattgccgctcttcgtctgcggaaatttcctgtttcaacttaggaatgattaaattccaaggaacactttttttcatgatcatgatgtttttataggccttcacttatatgacacatcacttgggtttaacccttattccaattccaattatttttttaataaatttcgaggaacaaataatattagtatctttgccgctcaagaagcccttatctaatataacttcgatatgcctgcagaagatgatatcctattgttacagttaatcaaacaagatgacgagaaggctttcaagcaccttttcgatacttattttgtttcactctgccgcttcatgtccctttatctgagagacaagcaggagatagaagaactggccctttccatctttatgaatttgtgggagggtagggccgacttgactcttaaaatctcattcaaggcttatcttttccagtctgcacgcaatcgttgcctgaatgctttacgcgatgaaaaggatacggttcccatcgagggaggagaagaatatggatatgctcttgcggctgatacttcggtggagatggaagaactgaaccgattgattgaagaagctgtttgttcccttccggacaaatgtgggcaggtttatcgcaaaagtagggaggaagggaagactaatcaagaaattgccggggaaatggggatttctgtcaagacggtggaggcccaaataaccaaagccttgaagcatatcaagaaatttttaggagaacagtatacttatttgttctaaaatagaaattgcaggccatctgtcttttagaatgatgaaaggaggatggcctgcaatataaaaagaagattaatctataaccgtgaattttactttctggtctttcactattacataatattctccattttcaaggaaatgttcaccattggcatttacaaaagcaagatcacgcatcgggtctatttcaaagcggaatatatgtgtttcacctgctttaattagttgcttttcgaagtgcttcaactctttgcatggacgggtaatcgtgctaaatgggtctgagataaaccaatgcaccacttctgcaccgtcacgtttgcctacattggtgactgggatttccattaccaacttttcaccgcgtctgatggtttctttgggcaagttgatattaccataattaaaggtggtataactcaagccgtatccgaattcatacagtggggtagaggggatgttttgatatttgccactttgtggacgggctgttttgcgctgattgtaatagattggaatctgtccggtggaacgtggaaaagtaatggaaagcttgcccgaaggatttacccggccggacaagacacctgccaatggtttaccaccaggtactcccggttgccacatttcaacgatggcgtcacagagaggttccactttagagagtcccaaaggacgtccgttagccagtgccagaacaatcggtttgcctgctttcttcatttcagcaatgaatttctcttgaatggcaggcagttctatgatggaacgcgatgcgttttcgccactccactttttcttttcacccatacagagtagaatgatatctgctttccgggctacagccagtgcctcactgaatttggaagtgtcgttaccgtcgaaatcacaaccctcggtataaatcagttcagccttgcctgcaaattctgcatccagtgcctttttgatggggaggacatcttctgcatgtccatgtccataccatgaccccagaagctcggcactgttttgtaccagaggtcccatgacggcgatagttggcttgttcccgtttgccaaagggagtaccttgttttcattcttcagtagaacaatggtctcttctgccagtttctctgcaatagtcaggctttgtggaaggaggaagcgctctttttctgtagatgtcggggtgtagggattgtcaaaaagtccaaggcggaatttgatacggagcacgcgtttcactgcatcgtccaccagttgcatgcttattttaccttcttccaccagctttgccatatgcttgtcatagcaatgtcccatcatgtccatttccagtccggcgttgaaagccagacgggcagcttctttgcggtcggcagcatgaccctggtcaataagttgcggtactgcggaccagtctgaaacaacaaagccgtcgtgtttccaacggttcttcagaatttctgtcatcgtgtaatggttggcgcttccgggagtgccgctgatatcattgaatgaactcattaaagtagcggcaccggcttttacgccagcttcatagggaggaatataggtgtcccacagagtctgattggagatttccgtataaacatagtcacgtcctgcttcagaagcgccgtatccgatataatgtttaaggcaggcggctactcgcttgctgtcggacatgtcttcaccttggtatcctttgatggatgcgacaccgaatacagcattggtataagggtcttcgccatagccctctgcaacacgtccccagcgtccgtctcttgccacgtcaatcataggggaaaaagtccagtctaccccggacatgcgtgcttcctgggcggcaacggcacatgcttgttctaccaattggggattccaagaacatgcttgtcccaaagagatgggataaatggtacggaacccgtgaatgacgtcgtatccgaaaaggatggggatacccagacgtgattcttccattgcttttctctgagcctcgttacgcagattggcatcttcatcaaaataaatgagggagcctagagtggcaggaattttttttacttcctcaccacgattgttctcgttgttattccgccccaaagtgtactggttgagttgttgtaccttttcttccagcgtcattctgctgaccaggtcattcacacgctcctcaatgggagctttggcatctttgtagatgggttgctttttgtctgcagccattgctccggccaggcaaccacttaaaaggaggcaactgataaatgttagtttcttcatgatatatataattatgctattctcattaaataagacatgtttttcggaatctgctcctacacaaaggtcgtttttttaaggaatataaacaagtacatgcaagggcttatttgaaaataggcttatcggttagtgtcatggaagcttgttcgttattttttagttcaaataccactatttcattattacctgctatcagagcaccggcaggtatctccagggtcttttctgcattttcttcccagtaggcacccaagtattgcccgtttatccagacttctcccattccccagccggacacgtcaagaaaggtctcttgtgccgggttgcttactgtgacacaacctttacggaagcaggggatggaggaggcgccttctttgaaagttattccggccacatcgcattccttaatttccaatggggtcatcttccagccttctaaatctttctttcccaatgttatgctgccgtagataccttttgaattgtccagaatttcagggccataggtaatacgtccgatattttcagtatagatactaagtttgtgtatacctatcggtagattggttttcagacttttactgctatcttttaaatatccttgcagtttgccgtctgcatagaccacagcataatcccgtacgttttcaatagttagtgtgggattctcttcttccacatcaacggttgtctcatagagggcatagccgaaatccatatccagttcattcatgggcagtaaggcatcatcttctactgtttctccataaacttgttccaatggagctgtttgtgacatttttatctcttgtgctgctgccagcccgaccggcagcaacaaaagagcccaaagcaagaataatttcatcatatttcctttttatttctttaagaatgattcaatgtaggactcgtcaacggtaatttgcggagcgaatttgtcactctttacgtagcggtcaatgctttccagcaattgctgggtggcaggacgttcgttgatgtttttctgggtatctacggccagtaccagtagactgcctttcttcacttttgcttcgaaaccaataccgagcttttcattattgtcgtaatggtctattacttgtatgaaaggccgcagtgctaccggagcatctttcatctcaataaccttggcattttccagaatgtcccaccactgccagtcagtatggtaggaagttatgaaatgctcgaatataggctggtcgtcatgaatcagacagccaatggtcataggaggccatttgaacattatcggattccaaaagtgattgtggaacacggatttacgaccttttactttggaaggtttggggcagagtaccactttcttgccatcggcaaggtgttgttttgctttttcatcgaatactgtggtgtagagcacttcactagtggactgcattaagttgctatgacggggatatacccagatatcccagctgttttttacgtgtgcaacagaaagatggaccgtcagcttctgtggttcagtgatattgtccaatgcataactgaaactgccaagtggaaataccccgttctttccgacagtttgtgttttcagttttccgctcttaagggttttaccgttgctgtcggtgatcctccaattgatttttgcgtttttcaatagggcaggtccataattgtatatttccgcttttccttcaaacacttcatcattgtaaagtgcgcgtttgtcgaaacggagcaatgcgacagtcggtgcacagaactcgcgccacttttccggtgtgatgagccctttggtattccagaaaggatcgagaatgcctaccggtgcatatccttgtccggtaaaatcattcagagacagtaattggaaaccgcctttcagataagtgcgcaactgggcttctatgacatccttgtactctatggcggtcaaggctccagaagcacggaagaagtcatgtgcctggtcgagcatgtggttcttgtccagcagttcacggaatatctcgaaattacgcgcttgtacggggccggtgaagttcttcatttcctcgaaattgggatagatgcaccgctgtccggattcatgcgagatgatgggcaggcctactcccagttccttgtttttgtcccagtttgtataagggcgtccttcgtagatgcccatgtgtcctttggtagtctgatgggtaatgtagaactggtctgatttgacacgtgtgcgggctgtggaaccgctgtatagacggcggttatccaactggcgggccgtggcggtaagctcttctatgaaactgaaatcgccggtaatttcgtttccgttacagtagagaatgaaggaagggtgattcccatattctttcaagataccccgcagctcgcgacggaagaaattccagcgcttctcatcgggttgggcatctttaccccacatcggcatttccacctccagatagacacccagcttatctgccatacggaacgcagcggcaggaggacaccaggagtggaagcgcatatggttcatgccatattctttcaggatacggagtacacgttcccaagaggcatcgtccacgggagcgtagccggtcttggggaacactgcgttttcaacggtaccgcgcaggtgtatgggttcgccattaaggatgatatggtcctcaccggcctctacttcgcgcataccgaaagttgtgcttttctcatgcgcataggattggccatctacactggaagtcagcttacagtccaacgtataaagattgggatggaactcattccacaaatggatatccttacccaaaaacatctcttcctcgatataagtaatggaatcggtcactgttaccggtacttccttttgcagtctatagtcctttcctgtcacgtggaaggatattttgccgctggcggtatgttctgtacagttgcggacagtcattttgactttgatgcttttgttcttgatgtccggatagacctgcatgtcatctacatagaccgggtctacagctaccagcttaatttcgcccaatactccgttccagtttatttgggtaaattcggagtgggcatggtcccatttatgggtatcgtactggtagcggttgtctatgcagaaagttatcagttcttttttgcctggatgtagccattgggtcagttcgtggttgtggggaatactgatgtagtctattttactcacttcttctttgcctacatataccgaactgagccagtgtgtacgttcaaaatagaggaaaatgcgtttgcctttccatgccgcaggaatctctatttcccgctggtaccatgcggggcccatatattcgtagacacgggtcagcctatccaggtggcggtaaggagatttgtagcctattttatagtcatctgtaattcccggcagaacgatgctttcctgcaggcgatggcagtaacgtacgtccagtgaacctctccggaagtccatgacatctgtctggaatgcccattcaccagacaagtccatttcattcttttcttgggcatgcccgctccagaccatagaggtcaggaggagggcagccatgtagtgttttattttgtgcttcattgttctgttttcttttggttatagtaatcacgcatgatgtaccatgcttttttgcgttgtccctggtcggaaaccagtcctttacggttccattcccctccctggtgtggatggaaacggaagggagaacggaaatccaaaagaatccacggcgatgttccgcgcaggttggggatatgcttaaacatttccagattgtccttgtagagttgtgcctgataatcctcactccaagaactcttgacttccgcgtcgccatgtttgccatagagcgcttcgcctccgaactcggaaatgaaaagaggtttgccgggagctacattccagacagcctggtccggagccagtggccagtcatgataccatcccatatatttgttgatggctaccatgtccaggatgttgataatggagtcattcatctcaaagttccggctttcgcggttgaagcgtaccaaatcgaaggcggccgtaatcagacgggttgagtcgatgtccaggcaacattgtttcatgtgtttcagaaattcattgcgcggggcggaagtggctgtttcattggcaatcccccaaaaggcaacggaacaacggtttttgtcgcgcatcaccatctctttaatcattctgcctgctttctcacgggtagcggtatttttgaagtcaatcccttgccagataggtatctcttcccataaaagaaatcccattctttctgctaggcggacagtatattcattttgtggataatgtgccagacgaatcatgttggcacccagctctttggcttcggacaacagcattgttgcgtccgcttcagagaaggcacgcccgcggcgttgcggaatttcctcgtggaagctgatactgcgcaggaagatgggctggtcgttcagatagatatcttcaccttttacataaaggttacggaaaccaatttgctcgttgagccggtcactttccgaagtgatggttacatcatacagctttggagcatccggtgaccaacgttgcagttttttggttttgatagtggcctgggcaattccgttggcatcggtagtcatgttctgtctgatgcccaattcggggatggcgacttgtacgttgatgccaggctttgcttcggataaggttactttggcacgaatcaggttggattgtaccttgtccaactggatgaaatggtctttgatgtagctttgtggaacgcttaccaacattacatcgcgtgtgatgccgccgtaattccaccagtcaaaggacatggcagggatggcatccgtggtgcgggtattgttgactttcaccaccaggaagttgtccttttgctttaccttatctgtgatttccacctggaagggagtgaatccgccttcatgactggctattttctccccgttcagatatattttgctacggtaacttaccgcaccgaaatagagaaacaaacgtttgccgtcagtctttggggtatcgaaagagcgtccgtaccatacagtcccttcataaaatttcaattcgggcatttgtgaattgaaatcggcaggtacattcaggaccaaacctccgtcgaaagagtattcgtaaaattgcttgttgtcctgaggttttctgtttttgtacacctgcatcctttccccttggtcataaaggtctacaatggctccccacttcccattcagtagccggtagtcgcgtccgtaaacattggacaataagtcttgtgcttgtgacttgcctcccagtacagacactgcgagcaaacaagtaatcattaatcttttaattctcataaatcgtatgtatcagttaacgtttaaaaagcctatggattattctttgtatattttcaatgcgcatccgcctccttgtgccattttgacggtcagtttacgggatgcaggaatgtctgtgacggtcttttggtagtcggaagccaggcggttggcattcactccgtcatgaaacatttccgctttccatctgcctgcaccgaggaaagaaaggtccagtgtcagagtacgtgcatcccaattggttagggagccgacataccagacatctcctttcctgcgcgccattgtaatgtattttccaatttctccgttcatggctattgtttgttcccagacggtagggatggtagcgatgaattccgtgcattcttcttcacggtcgtaattggtgggactgtcgcacaacatgttcaatggtgattcaaatactacatattcagctaattggcggcaacgggttccctggctcattggggtatccattgaggagtggtaacaccgtttgttggcattgtgcatggcgccttgtgtatagtccaccggtccggccagcatacggataaatggcatggtgacatcgtaggttacctggtcgatatggatgtcactccacttcatctgttccagcccgtgaacggcttcatagttgatgacattgggataagtgcggttcagcccggtaggtttgtacgtgccgtgaaagtctaccatcaacttatatttagcggcaatttcggcagcccggtagtggaagtctaccatttcctggtcatccctatccataaagtcaatcttgaatcctttgatgcccatttcggaatagtgcttgcatacatgttccatgtcgcgggcaaaggcatggtaacctgcccaaaggatgagtcctacattcttttgcctggcataggccgtgagcttttttaaatcaatttccggtacaatttggaaaaggtcagccttgaggttgacagcccagccttcatccagaatcacatactcgatgccatgccgggaggcgaagtcgatatagtgcatgtatgtttcattgtttattccagcttcgaaatccacgcctttgattccccaatggttccaccattcccaggccactttgcccggacgtatccatgagatgtctttcatgcgtgatggagcagccagcttataaaccatatcgttatctgccagctccttgtcatttcttgccacaacaatgatgcgccagggtagtttggcttttggctggcaggaagcaatgtagttttcacgctctgtgactaatatttgcagttggttatgcccgccttgtttttttgttttggggacggcggcaaaagcggaagtgagtgctgttcccccgtttctgttgatgaggaacatgcccggatagctctccacgtcggattcggcaatacaaagtttacggccgttttcctgctctattactacgggggtaaacatcagtctttgggggttcagtccggatagctctatatgtgtataggtgttttcaaaagagttggagaactgggcttctatcggttgtttatcgccatcttttacataaggaacaatcgatttgtagtccttgttgaagttgaaggcggcttcttcgtttgtaactttgaacggtctgtttccggtcgctgcgaaccggtatgccattccttcattgtacattctgaaaatgaggttgaaatgttcccggaaacttaacgtcatttcattatagacatcctttacttcactgcgtttgtagaaaggagagggaatcacctcatttgcctggcgatgactgactctcttaagatgggagccgttaccccagactgtcccattatccagatgtactgataagggagagggggctaccaatgtatgcccttcttccgtcagctcgtaagtgatccggtcacctatatataaggtaacctccaacttgccgtccggtgagttcagacgatattccttttgtccgaacatgttcgggatgatgaaaagcagtgttgtaataaaaaaaagtattctcatgattcttatagtttttatttgttttgttgaaagaaatcagcgacccatttccatgcggctgcccattgttctgggtaggcataatgagccgtttcttcggatactaatatttgtttgggtgcttgaattacattgtaggcagaataggtagtagtgggtggacagaccatatcattatatccgaatgagtagaatccgggaacttttatttggcgtgcaaaattaactgcgtcataataacgtgctgtatttgccttttctgcagtctgattttcttgcttgttaaacatgtgtggccatcctccggcacggttatgtatatagccgaccatgtcacaaagagcagggtaaaaggctaccagtcctttgacacgtgaatcaagtccagctgtcacgatggacaatcctcctccttggctactgccgaatgttatcaaattgctcccatcgaattgtggtagggaataaataaagtcaatggcacgtacacagcctagatatacacgtttataatagtatttatcccgattatccagattgaacgtgtggtacccttttaatgctcccatatagagattggtatataccggtcctgacatgttgaccggaataccgtgtattcctatttcgaaaacaatccagccattggcagcatgttccacatctccggcataagaacgtattcctgcacctggtagctttaaaactgcgggatatcgaccttttgctttaggcatagccagcatgccgtataagcgtgtatgggattcataattctgtatattcacatggaatacattcactttctctgtacaacgttcgggtacaagggtcatttgtacatccattggtgtcttttgagcctggagttttgctgtttcccagaaatttagaaagtcttcgggcaatgatgtgataggttttaatttttctggattgattccaacggttactatcccttggtattcacgtcctccatatttaacaaaggcttggcaacggagaaagccaggtttttccattgttttggcttccaccgtggctgtccctttttcagcttgcaatatgccttctttgtgaggcttcatcatatcttctgaaatctcgtaccgaatttctgtgtcaggaattggtacgttgtttttcagtaccgtaatgctgaattttattttttcgcctggcttatatagccagtctgtatgattgggagtgatctgtatccgaatcagccgttcggcaggttgtccgaaggctcggtaaaacagcatcaagaaggcgattaagagtatactccttgtgattttcatgtcagtctttattttagcgtttgtttttaatttcatacttgtagacaacatagtcattgattgatggcagagagatttccagccttcctttctttccggttactgctgtcatcgctttgccgtgtcccatcaatgggatacatcttactgtgacaccttctggcagccaggtatcgacttctgtagtcccttctggatgattttcacggtacacaatcaagtatcctctatctttctttagagactggaagccggtccaagagcgtcccgatggttcatctcctatgggtaggatagtgccggaatgcatgtcatgctgaaatttcttgtaggcttctgtatgttctcgtaatgtaaatgcttcctcgggtagattggtaccttccatccaggcaagcggctgtcctgctaaagtcgtagcaaacagatattcaaatgaatagttttctggagcgaagacttctcctttatatttatccgtatttctccatttgttcaagaactctatttgcagcttttctgccggaacatatttggaaagcatccagaggttacgcaaagtccagtaaggatagtagttctgccagtcggtataacggttttccagaaagatatttccatattcattgaacatgtggtagcctccgcggcggctggctgtcgcatcaaggttgaaaatcacttcctcgtccgtctcttccagcactttgttgaataagcggtgcaggtttgtttcggcttctttactgggaatggtgagcccgtctatcttgaatactttgatgccgtattcgcgatagaggctgatgagtgcttgcgcatctttctgccaatcggcaaaatcattttgtatgctgggattgaaccaaagaccgatttcaatacctaattccttgccacgctttacgatgggatgcaaaccacgtggatacttttgcggatcgggtttccagtagtctttattgtcccaaatgttcttgaatgaaccgcgggctacagctgaattaggacttttacctatttgccagccatcatcaatctggaaatgggtgattcccagacgggcggcgcgttccagttctttcaaacagaaggattcgtttacttttgagtcctggctacggtctccccaggtgttcatcataatcatctcgtcgcggtcggcccggtaagtacgtatattcttctgatatgaacgaagcgcttgtaggcggctcagttcatcttctccgtatattcccaatacacatccgtatgttttggtccaacggtcgggagtcacgtctttctcggtaatgcccagaccggttactgtaaactttccgaaatcagtcagaaaatcctttccttgataggctaattgtaccgaagagcagggagcctcttttaaaaagaagatgccacagttgtcctcgccattaaaggcaaacagcagattgccgcgatatcccagtttgcggtaggaaataatctctttctcgaaaaccaggttgttgtgccagtcggtaacatcggaaaattccacgctgcgagcgtgccaatgttgtccttggaaatggaactggtctagtacagcggttacttctttagatttcatgtcttcggcgaattcaatattcttccggtcggctgcactaacttctctgcctccgaaaatactgtttactgttcctcttaaataggtgtcgcaggctatggctggacaatcatcataaatacgatatacccgttttatatctagcttctccaggctgaaagaaacttctactttcagataagcgggaaatattttagtctcttttacgggaactactttgagtgaaccgtttgatggttgcggcaaatctttcgttactctgaaatctggagtaaggctgtggttcttccatgattttccattactcttgtcggtcaggcggtaagttatgatatttcccccgttccacaaaaaggtacgttcgaccaaattgttcccgatggttaaagtgtcatttctcagaaggccgtagcaggtatcttgtgcgtgtaacgaatatcctccgaaaaggacaaataataatgttagaatatttttcatgatatgcgtgttttattaatacttaaattgtagtatcaacgtgtttcttacttcttgtttttttcaatggcaaatatacgaggcttttttaataatttttgttcattgaacttctgattatcgggaatcccttctttttttcctactccctctttcatcagtgctttcaattccggtaggtgtttctgatatactcctctcggagtggtgttgtactttttacataaggaagctgccatcccgacaacttcgcccatcattccggtggtacgcattacgcggacagtgcccagtgccacatgggtaacactgatattgcggcccgccataaaaagattctcgatatttctggaatataggcagcgatagggcactgcataaggatatatatggatgtgtttggttgctgctttgaaaggcgcatcaggaaagtgtgatgcattgagcgaatccgggaaatgcaggtcgatgctccaggttgtgacgaaggaggcatcttcgtgatagacatttttatctatatcatcttgctttagaatataatcgcccaacaatcggcgtgactcgcgttttccggcaatataggctacccagtccaatgcgcggttcttatatttcttgttgtcctttaattcatttttcagaaaactccaattagaatagatgaccattaagccataatcacgtatacgttcgaagtcgtcgatttgattgaagttcatgccggtttcccatttccattcacccatcgtcactttttcgcaatttttttcattgaattgcagaccgtacgagaaaatagggaaacgggtaggtttacctttgtctgcagagtaccattgtacggatgaacccattgtcattttgtccggttgaattggtgccagctcttctccgtattcggcacgggattcgcgtcccatgttgtagtctgcaccggccagatacccgatggtgccgtctccggtacagtcggagaacaatggtgctttcagttccacttcttttccattctctatatgcttgatgatgacagattctattctgttgccatcggtctttacagatatggcacggtagttggcataaagggtgatattcttttcattggcgataaaaagctccttcttttcatcttcatagtttgcggcaggtttggcatttccttctttagaatgtccgaattctcttatcatacgtcccagtccggaattggggcctactccgatattgccccctaagtgaaccctgacttcagagctattattgccgccaagtactgggcggtcgttgattaatgccactttgcatcccaatctggaagcggttgcggctgcacacataccggctataccgccaccagttacaatcacatcataggagtattgctccggttcggctggaatatccagcatctttttacggagatctgtcagttgtacagtttcgttaggaggtagttgctctttttctgttgtaaaataaatagcatcgcaacggccattgaaaccggtcaagtcttttaatgttagattactattcccagcctttactgaaatttttccggcgggttgccacatccattggttgccttcatcccctaaaactataggcagctttttattaccgatttttagagtgaactttcctggtcctttgccatcatgccagggagaagtccagttataggtacgtacatatacataatatgtaccgctctcgggaaaagatatggtagtggaagcatcctcaaccgggacccccattccatgagccattagatagggtgaccccataaggtccatgaattgctggtctactacccatcctcctttttggtcaaagctttctgcttctatcaatagattggaggctgtgataagctggctacagaacagtagacttaaaatcaatataattcttctcataaatatgcggttctttattttgttgtggaaacggtataaaagggctgccctggatttctaatttgcaggggcagtcctttcattacagtttgtttatccttttattcacaatctttttacctataatgtctaaccgttaataccctggattctgtttcatgttttcattaataatgatttcagatgtggggattggccataaatactgccgttcgtcccatttgcgctgggaaagtacttggattaagccttctttttccatagcagagaagtctgcgattccatcttcatctatctgtggtgtcgtaggccagaaccacagtccttttgatgtaactttgtctcttaatatgtcagcaggatatagaatgccgtagttcttggtgttcagagctttggttgccaatttccaacgaatgaggtccatgtagcggagtccttctttagcaaactctacgcgacgttccagtctgactgtctggcgtaaggacttttggtcacgtgctgttactgccggatatttgtctgtttcagaagatttcactccgtatgctctggcacgtacactattgatggcttctaatacagattcgtcaatcttgttcagttcaatcatggcttctgcataagtcaacaatacttctgcgtaacgtatttcaatatagtcactttccactttttgtttgttatctacccaagaatcgtcaataccctttttccatagcaatgcattgaatgaggtgtattgcgcattggcacgggtatcttggttggttaccattttaccggttttgtagttcattacttttaatgcatcgggatgaggatcaaagtcaaagctacaatggcgggttccaaattctacaatggtggcagtacaacgggggtcacggttcttgaaaggattgtggggatcaaaaagaggtgactcgtcaatgggcaacccatctgtacagaggaacgaagccaacaagtcccaagagggtgcatacgaaccgtatcctccagcatttctaggcagctcattttttgtggcagtagcatcgtatagaatgttgtattgcacggaacgtgggaatacaagaatgctttctatggaatttttggtattcatcagaaataagtcgctgaagtcgggatgtaattgataagcttgcaaattcatacacgctttagctgattcggccgcaagttcccaatcacccatgtaaagggcaaaacgtgctttcatggctaatgcagcaccttttgtgaaacgttgtgtcgagttaccggtataagatactggtaacatagaaattgctttgtcgaagtcttggtaaattaaaggtataatctctttttttggagtacgtcctttttggaaggcttcttcaatgtaaatattcttatctagccagacaacatcaccaaagaaagaaacgagtactgcatatttacaagctcttgtaaagtaagcttctcctctgtattgattcaatattttttcagagacaccagccttttcggcgcgctcagatttttcaagaaatgtattggccatcgttatacatttatagtttgattgccattgctctactggataccagttctctgttccaccatcaccatttactgtaccgtctaggaggttgcaacgattcacatttctataggtgaagttgtcggtggcttgttccagaagtccctggttcattttattccaatatccgattttatagaattcattggcagccatcaatagttcttcttctgaagaataccagttttcagtggaggcctcagacaatggaactaagtccaagtcattgcaggaacttgctaaaaatccaagtcctaaagctaatattataaatttatgtctcattttttttctttcttttaaaagttaacagatacgcctaacaatatagatgttgtgataggatattcacttactcccatttcagggtcccatcctttcggatatttgctcaaacagaatagatcggaagcactggcataaatgcgtgcacctttgatacctattgcgttcatccattctttagggaatgtatagcctaaagttatatttttgagacggaaataacctccgttgaacagccaataatctgacatggcatagttggaacttttgtttacatgggttagacgaggatatttggcaactgcgttttgttcgtccgtattataaggactccaatagtttccatcaatgatggcggggaaatttccgtaattgttacggaatggttctaccatttctcttgccaagcgtgcattttgttttccgacaccttggaatgccaatgaaaggtcaaaatttttgtagcccaaattgatattaccaccatataggaaatggggtaatgagctgcctagtaatactcggtcatattcaggagaaatctttccgtcgggtacaccgtcaggaccagatatgtctttgtatttaatatcgcccaattgagtgttcttatcattgattttgggagaattctttaagtcttcttctgtcaggaaaagaccatcgctaacatagccataccactcattgaattcactgccttccattttaactttgtcaccgaggaattgggttccttgtaaatcccccattttggaggtgaagtcagagaagttaatggctattccgtagctgaagtcaccgatgtggtcattccagctgacattcaattcataacctttggttgacattttgccggcattgacgtctgggtcagagaatcctagaaaatcagggatagccattgctaatagcatgtctttagtatttttccagtaatagtcaccgttcacacgtaagcggttgttcaagaaagaaatgtctaacccaatgtctgtagattcagttttctcccatgttacattttcaatggcatatttctgttgagatgcagtttggtcaaaataaataccgttgttttgatagaaaatagtgttcccaaatgcaatggttgacatatatggaaaatcgccaatacgttcattacccaatgctccccatgtagctctaatcttcaagaatgacagccattcccaattaagattcttcatgaaattttcttcgctgagtacccaaccggcagagaaggaagggaatgtaccccatctgtgtttctttgcaaaacgtgatgagccgtcatgacgtatattggcctggaataaatatctgtcggcatagctgtacatgacacgtccgaagtaggaacgataagcgtactcttttccttttccagagttgccaattaaatctttaggtccattattgaggtatggaaagttcgtgagaacgtatccgtctctgtcagcacctaattcttcaatatattcgtaatagttttcgtaacctgccattaggttgatgtcatgttttccggcaaacttctttgcatagtttactattaattgcgtagtgacattgtagctgtcattgcgggtttctgagagtttggttgtgttgtatagtccgctgttatctaagtatccccctattgtattgggatcatctgccaatgtatagctggctgctttcttgaatgttttgaacttgtcgtaattaaagcggggagcaacgattgctgaaattttaaatccgtcaaaaggcttgaaatcaatagatgctttaccgcccaatgctgtgtaccatttttctgttgtaccacccaatttcatcaatccataagggttggctcccgatttgccttcagctatacggccgtcatcccatactcctgcataaatagcaggcatgtagcgcatcattccgaatggagtgaattgcggcatgtggtgtttagtgcgcttaacattgaagtccaatgtagcacttaacttttgggtaatgttgaagtcattgtttacacgtaatgtatagcgttggaaataacggtcaccgtacagaccgcctacttcatcatacgccaaggatgctttggtcttaacgaccttgctgccgcctgaaaggtggatactatgactttgacgggttgcggatttctcaagaatcagatcttgccagtcggttataggatactggttgggattggttgcattgtttttcacccagttattaacttggtcttctgaataggcttggtatttgccaccgtccggattatctgtatatcgtaattcattagccatttccagaaaacgttgcacgcctacaacctcaggctctgcggtaggtatttcccaaccgaattcaccgttataggtcaatgacagttccttgtcactggctcttttggtggtgacaagaataacgccagcagcggcacgagaaccatagatagcagcggaagcagcatctttcaatacagaaatgctctcaacgtcgttggcatttactgaattgatgtcaccaggcactccatcaacgataaccagaggatctgaattcccgatggttgtgataccacgtacatatatcttgtctgcatttgcaccaggcgcattattgttacgggttaccattaaccctgggatggttccttgcaaagcggtggaaagggaagttgttttacgggcggctacttctgcacctcccacagaacctactgcaccggtcaagtctttcttttttacggtaccataaccgataacaacaacttcttccaaagtctttgaatcttcttgcagcactacattgattgcgtttttaccgttgacagcaacagatgccggtatatagcctacgtaagaaacggttagagtagctttctccggcacatcttccaatgtatattcaccgtcaatgttggttattgttccttgtgtagagcctttgataataacggaagctccgataagcggctcatcattttcgtctacgattctaccggttactttctttttagcacctacggatttgttggtttgctggaacagcaaaatctgcttgtttgcttttatttcaaaggagattttcgttcctttaaataattctttcaatacggcttcaagtgaagcatttgatacatttaaatccttttttgtttcaagattgggaagtttgtctgtgtagaatacgttataaccgctagctttttcaatttgcggtataatctgcttgatggtctgcttgtttacagataaactgatttgggcgaagctgtttccccagaaaaacagtgcacccagcagtactaaagaccgcataatcattttgttttgtctcatgtctaataatattagattaattgttttttattttgagaaaggcgtaccaaagacctgctctaataagatattagagtaacttatgacgaatttctcgtgaatgtttaaactagaattttattttgctgccgaaagctggcagttgtgtttgatgaagtaaaaagtttataaaatctattccatattttcctttttaagttaacataaagagtttattaaacactactaatatattacgatcgtattatcagattttattttgtaattaatgccgccagcttggctgatgtattctaatacattattcaaactgctattcttgatgatgccgtgataagtatattgttttactttctcgtttttgaatataaatttgcaattatacattcgtgtaagcatggtacaaatttcttcaaaagattcaccgtagaacgctagttcattgcttctccatagcaaataacttgcattaggatgaagctcgcttttttcgaactgtccattggtcaggttgcaaacgagcctttcgtttggcttcatatatgcctcgtgtctgccgtcgtctactttaacctttccacttatcaggcttacagctactgatttatcgtctttatgtgcacgtatattgaagcttgtacctaacgcttgtacattgatgccatttgctttcacgatgaaaggcttttccttgttctttgcaacttcaaaataggcctctccttccagggagaccatacgtgttttcttgttgtaagtgttgtcatatacaattcttgaatcagaattgatgtagacctttgtgccgtcagccaaaatgatgtcggccttctgcccgttggatacggacatggtgacttctgtattggcgtcatcggccggtcgtttgactcctgcataataggctccgcttcccactgccaatatgatgtaggcaactgcagcatagcgcccaatctgacgcaggaaacggttccttgttttcaggaccttcgtttccgtggtggaacttgcgtctatctggcttaaaagttcggtgaacatttcattttgtacggctttgtccatcgtgtccggagccagtgcccagcattgctgatagtatgcggaaaatttctgttgaaaatccggtcgcttaatccatgatttcaactgtacatcttcttcagggctggtcagtcctcgaaagaaacgatccaaaagttcaatatgactgtcttttttatccatgttctgtagtatatatctgtatgcctgccaaaacactcacggattttcgtgctttaacaattatttagaaagtagaaggagaggaaaagcatgatgaatttgcgtaattcttctttcagtagtttcatagtacggtagaaatgagcctctacggcacgttccgtcaaatctagctgtgaggcgatttccttgttggacagttttcctgctcttttcagctgaaagacttcccgtgaaacttctggcaggctttgcagaagttgctctatctgtttttcaatgatggagacgtccatatccatcgtatcttcctcgatagcctctgcttctgttttcagcttgttttctacaaatttgttgtgtaataatcttcgttcggtttctttgtataccatgttgcgtgcgatggtgcatagatatgccggaaaacttttctcggtatccagattactgcgttttccccatatcgtcatgaagctgctttgggtgatgtctttggctaatgatttgtcatatacgagaaggacgatggtgttgtacagcctggcactgtatttttcgtacaatgcttcaaaggcaaatttattgccttctctcaacttggctaccaataaagtatcattttctttctgcatattgattcatcttacatttacgcattctgaatggtagtgtctttgtatagtaaagtactattccacatagactctgaaagaatgaactacaaaggtggtgtttttattatttatttaaaagttttttgctgaaaatatactttgtgtgattattatttaattctatattccacgatgaaggaggatggcagaaatagtcatttgcagtataagaagtggtaaactgatggatgggtttaggggcttattgtcaatacattacatttacagcgttgttacatccttatgtaaaagacgttacatgccggggaaagactctttacacaccggggtaaaggccgttacatatcggggtaaaggtagttacatcctggggtaaatggagttccccactgaggtaaataagttatcctgctggagtgaatgaagtgatataggcttatctgatgtccaccccccacattagtttattgcgaagggtatcaaagaaaatatggttgaaccgtttcactacctttatgctatagtcggcacgtgagatgtgcaactgggtcgtttctttgcaggactcgctacggccgtcgatggcaaccaagaagttgtggctgcggctttccacatcaagtgtaatttcccagtcgtcacaaatgacgatgggacggacgttgaggctgtgtggagccaccggggtgatggcaatggttttactgtggggcacaatgaccggaccgccgacgctgagtgagtaggcggtggaaccggtaggtgtggagataactaggccgtcagcttgataagtggtcaacggagcgccattgatggcggcgtggatactgatcatggacgaactgtcccgcttcaatacggctatctcattgagggcgtaaggggattgcatcaagcgttcatcgtcgcacctcagttgcagtacactacgctcttccaccttatagtggttgttgtagatttcatcgaaggtctcttccatctcttccggtgagatgtcggcaaggaaacccagccggccggtattgatgcccaatatggggatattcttctttcctacacggctggctgctttcaggaaagtgccgtcgccaccgatgctgataaccatgtcggcacagaaatcatctccgtcaaacaattcggcgtcaggtatgtttaaatgtaaatcggtagtcaggaagtgatggaattcccggcagatgcagagctgtgcattatgctgtccgagcaaccggaagaggttttctgcatgcgaggatttctttgcttggtaggtatttccgaatatggcaaatttcataatcaattctgttggattgaagtgcaaagatgctatttttttctcagaatgctgccaatatataactattatttgtacttttgtcccaaactataaaccgaattatgactagattaagcgttaatataaataaggtggcaacgctgcgcaatgcccgtggaggtgatgtcccgaatgttgtgaaggtagcgctggattgtgaagactttggtgctgatggcattacggtgcatccccgtcctgacgagaggcatatccgccgtaaggatgtatatgatttgcggccgttgctgcggacagagttcaatatcgagggttatcctacacccgaatttatggatttggtcttgaaggtgaaaccgcatcaggtaactttggtgcccgacagccctacacagctgacttcaaacgcaggctgggataccaagacccattttgacttcttgaacgaagtgttggatgagttcaacaatgctggtatccgtacttccgtatttgtttccaccgatgccgaaatgatagaatatgctgccaaagccggtgccgaccgcgtggagctatatacggaaccttatgctacggcttatcccaaaggacgggaagcggctgtagctccttttgtcgaggctgccaaggtggcccgcagcttaggtctggggctgaatgccggacatgatctgagtctggtgaatctgaattatttttatcaaaacattccgtggctggacgaggtatccatcgggcatgcgctgattagtgacgcgttgtatctgggattggagcgtacggtcaaggaatataaaaactgtcttcgctgatgaatgtaatgttgttattggcccaagtggctccggcactgactgactctattgcaggtgccaatccggtactgacacaagtaaacgcttccgacgaaatgaatttatggagcatggccatcaaaggtggctggattatgattgtcttgggtttgatgtccgtactttgtttctacatcttgtttgaacgtaattatgttatccggaaggcggggaaagaagaccctcagttcatggataaaataaaggattatattttgggtggggaattgaaagctgccattgcttattgtcgcagtgtggatactccctcggcccgtatgattgaaaagggtatcagccgtttgggacgcccggtgaacgatgtgcaggctgccatcgagaatgtgggtaatattgaggttgccaaactggagaagggaatgacgattatggccacgatttccggtggcgctcctatgctaggcttccttggcacggtgacgggtatggtacgtgcattttggcaaatggcaaatgccggaaataatattgatataacgttgctttccggtggtatttatgaggcgatgattactacggtgggcggtttgatagtcggtatcatagctatgtttgcctacaattacctggtgacattgatagatggcgtggtcaacaagatggaagccaagacaatggcattcatggatttgttgaacgaaccggcgaaatgattaattaaagaattaagaattaaaacttaaaggcgtgttaaaacgtagagctaaaatatcacccaatttcagtatggcgtccatgacggacctgattttcctgctgctgattttctttatgataacatctaccatggtatcgcccaatgctatcaaggtactgctgccgcagggaaagcaacagacttctgcaaagcctttgacaagagtcatcatagataagaatctgaattattatgctgcttttggcaatgacaaggaactgtctctgacgcttgaagaattgactcctttcctacaatcgtgtgcggagagggagcctgaaatgtatatagctttgtatgctgacgaaacagtgccttaccgggaaatcgtgaaggtgctgaacattgcaaacgagaataaattcaagatggtgctggctacacgaccaccggaaaactaaatcgtacattgtacatggctaaattgtaaatgcaatggtgaatcggaagaagaaaggaaaatatataggtatggcaggtgcacttgtggtgcatgttgccattattgcccttctgatactggtaggattcacaccgccggaaccctcggaagaaggcggtgtacccgttatgctgggagaggtgcccgatgcactgggcgctgccgacccttctttagtaaaggtggatgtcatgccggaggaaaccgctcctcaggtgcaggaaacggtggagcaggacatcattacgcaggaaactgaagaaaccgttgccataaagcccaaagccgaacccaagaaaaaggaggaggtgaagaaaccggaaaagacggaagccgaaaaagcggaagaggcccgcaaactggcagcggcaaaagccgaacgggaacgtaaggaagccgaggaagctgcccgtaaacgggtagctggcgcttttggcaaaggtgcccaaatgggtagtaaaggcgatacggaaggcgaaggtattcaaggaagtcctacgggaaatgctccgtccggagccacttcgggtacgggaggctacggctcgtttaatttgggcggacgttctcttggtgagggcggattgccgcggccggtatataatgtgcaggatgaaggtagggttgtggtgaccatcacagtgaaccctgccggacatgtgatagcaaccagcatcaaccgccagaccaataccgtcaatcccgcattgcggaaagcggcggaggatgctgccaagaaagcccgtttcaatgcggtaagcggcttgaacaatcagacgggaacaataacgtattattttaatctaaaataagaggaggaacaattatgggtacagtttatgttttttttgccgacggatttgaagaaatagaagcttttacttctgtggatgtgatgagacgcgccggactgaacgtagaaatggtgacggtaacccctgatgaaatagtgacgggagcacacgatgttccggtcttgtgcgataagaatgtagtgaactgcgacttctttgatgcagagcttgtattattgcctggcggtatgccgggtgcgtccactttggagaagtgtggagaactgcgtaatctggtactgcgttttgcccaagagcagaaaccgattgctgctatttgtgcggctcctatggtattgggtaagctgggattgctgaaaggcaagaaggctacttgctatcccggctttgaacagtatttggaaggtgccgaatgtacgggtgctccggtagaaagagatggcaatatcatcactggtaaaggaccgggcgctgccatggagtttgcattggccgtagtggagctgttgcaaggcaaagagaaggtgcaggaactgaaagaagctatgtgcgtaacggatttatgattttaaatcataaatcataaatcataaatcataaatggttcagtatgctctgattgttgccggtggtaaggggttgcgcatggggaccgaactccccaaacagtttctcccgataggggggaaacctgttttgatgcgcactctggaggcgttttatgactacaatgctgagatacggataatattggtacttccccacagccagcaggattactggaggcagctgtgcagggagtaccgtttttcattgccgcatgccattgcagatgggggggagacgcggttccactccgtaaagaacggtttggctttggtcaagacacctgctttggtcggtgtgcacgatggggtgcgtccgttcgtggcccgggaagtgattgcacgctgttatgacttggcggccgagaaaaaggccgtaattccggtaatcggtgtggtggagaccgttcgccgtatggaaggggaaagcagtgtgactgtcggcagggatgattatagattggtgcagactccccaggtttttgatgcggaactgctgaaagcggcatacgagcagccctatacaccccattttaccgatgatgcttctgtggtggaggcattgggtgtatctgtctttttgacgccgggaaaccgggaaaacattaaaataaccactccttttgatttaaaaatagccacagctctgataggttcatgttcgatttagccacgcgtgacataaaatatttgtcgggcgtcgggccgcagcgtgcttcggtgctcaataaggaattgggcatttactccttgcacgatttgctatattactttccatataaatatgtagaccgcagtcggatttattatattcaggagatcgatgggacgatgccctatattcagctgaaaggtgaaatactaagttttgagacggctggagaagggcgccagcgcaggttgattgctcatttctcggacggtacgggggtggtggacctggtttggttccagggcatcaaatatttggtagggaagtataaagtgcatcaggaatatattgtgttcggaaaaccgaccttcttcaatggtagaatcaatatggctcatccggatatagactctgcttcggatttgaaattgtcgtccatggggttacaaccttattataatacgactgaaaagatgaaacggagttctctcaattcgcatgccatcgagaagatgatgaatacggtggtgcagcagttgcgtgagccgttgcccgagaccctttctcccgctatacttgccgagcatcatctgatgccgttgacggaagctttggtcaatatacactttcccgctaatccggatttattgcgtaaggcacagtatcgcctgaagtttgaggagctcttttacgtacagttgaatatcctgaggtatgcaaaagaccgtcagcggaaatatcgcggttatatttttgaaagggtgggcgaagtgtttaatactttctactcccgtaatcttccttttgaactgaccaatgcacagaagcgggtattgaaggaaatccgtaaggatgtaggctcaggaaagcagatgaaccgcttgctgcaaggggatgtgggaagtggaaagacgcttgtcgcactgatgagtatgttgatggcgctcgataatggttttcaggcatgcatgatggcacctaccgagattttggcaaaccagcactatgaaaccatccgtgagctgctgtatggaatggaggtacgtgtggaactgttgaccggttctgttaagggcaagcggcgcgaagctatccttgccggtttgttgacgggagacatacatatactgataggtacccatgccgtcattgaagatacggtgaattttgcttcgctcggtttggttgtgattgacgagcagcatcgtttcggtgtggcccaacgggcacggttgtggacaaagaatgtacaacctccccatgtattggtgatgacggcaaccccgattccccgtacattggcaatgacgctttatggcgatttggatgtgtctgtcatcgatgaattgcctcccggacgtaaaccgattgtcactcttcatcagtttgatagccgtcggataagcttgtatcagtccatgcacaggcagattgccgaaggccggcaggtctatattgtctacccgctgattaaggaaagcgaaaagattgacttgaagaatcttgaagaagggtatctgcatgtttgtgaagagtttcccgagtgtagggtttgcaaggtacatggaaagatgaaacctgctgaaaaggatgctcagatgcaattgttcgtatccggcgaggcacagataatggtggctaccaccgtgattgaggtaggtgtaaatgtgcccaatgcttcggtgatggtgattgagaacgccgagcgtttcgggctgtcccagcttcatcagcttcggggacgtgtaggacgtggagctgaccagtcctattgtatcctggttaccggatacaagttggcggaggatacaaggaagcgtttggagataatggtgcggactaatgacggctttgaaatagcggaagcagacttgaaactacgtggtcctggagatttggaagggacacagcagagcggcattgctttcgatctgaagattgccgatatagcccgtgacggacaactgctgcaatatgtccgtgaagtagcgcaaacggtggtggatgcagatccacatggcatgttgcctgagaacgaggtcttgtggcgacaactgaaagcgttgagaaaaacgaacgttaattgggctgccattagctgaaaaaacggttaaacatgcacttttattgcattttatgttgtaaaacatgtttgcttgtaaatctcctatctataggggattaagacatctttgcgagctttacagtttcctcctcttcgaaaaaatagttaatgactgatgtcgtttttcagagagaaatgttacctttgggagaatttttgaaaatcaatctggatattcgcgtagaacaagtggtgtttgatttgccgagatgcttgcaacggatatcaaaatgaatgacgaaacggatgaattttaattggataaaaactgctttattggctgcgacggcaatggttagcttgaattctttctcgcaagacctgattgcccgccaggcccccatcgacagaaaacttaagagtgtagattcactggctttgcaaaaacagatacgtgcggaacaatcattgtatccgggtttggatttgtatcccaactggaacaacgaattcgtacaagcctatggcaatgcgattgtgcctgagagctatacatttgatttgaccggtttctgtatgcctactcccaatacccgtatcacagatgtattcggttaccgtccccggagaagaagagctcattatggtttggatatcaaggtgtatgtaggcgatacaatccgtgcggcttttgatggaaaagtacgcgttgtcaagaatcaaggtcgtcgtggatacggcaaatacgtcgttattcgtcacgacaatggcttggaaacagtttacggacacttgtctaaacaattagttgatacaaaccagttggtaaaagccggcgaaccgattgcattgggaggaaataccggacgttctaccggttcacaccttcactttgaaacccgtttcttgggtattcccatcaatcctgcgcttatgtttgattttgaaaagcaggatatcgtagctgattcctatactttccataagacaaaaggctcttccggtacggcgcgtagcatggcatcgggtgaaggtctgttctataaggtaaagaagggagacacattgggacggattgcagcacgtcagggaacctccatcgacaagctttgcaaactgaacagaattacgcgtaaaacaatcctgagaccgggacaagtattgcgctgctcataaaaacgtaaacaatctctatagaagagggtactttaatagattttagagtgccctctttttctttttctttaattattcctatctttgcagcgcactgtgaaaaaaggaaatgaaagataccaagcaacaatttgaacatgtcattgcggtttgccgtgacttgttctctaagaaacttcatgattacggtccggcgtggcgcattcttcgtccgtcttccgtaacagatcagatattcatcaaagccaaccgtatcagaagtattgaaacgaaaggggtgactttggtagacgaaggcatccgttctgaattcatagctattgtcaactatggaattgtaggattgatacagttggagcttggttatgccgaagctgccgatatgaccaatgaagaggcgttggtgctgtatgataaatatgccaaaacctctttggagttgatgcttgccaaaaatcatgattatgatgaggcttggcgtagtatgcgtatcagttcgtatacggatttgatattgatgaagatttatcggacaaagcagattgaaagcttgtccggagcgactttggtttcggaaggtattgatgccaactatatggatatgattaactattctgtattcggcttaattaagattgaatttggagattgacaagaaacatattgtcgggaaagtttgggtgaacctctgccgttttctgctgggggctttgttcatattttccggatttgtgaaagctgttgatccgttgggtttcttctataaaattcaagattacctgacggctttcggcatgatttcctggtttccttcttatgcgcccttgctggtagggatagcgttgtctgccatagagttcagtgtaggtgttttcttgtttttgggtatacgccggaaggtggcatctgtattggcattattgctgatggttgtaatgactccgctaacactttatctggctttggcgaatccggtatccgactgcggatgcttcggtgatgcgtggatattgaccaattggcagactttcggcaagaacgtagtattgttggtggcggcagtatctgtattcaagtggcaggatttactggtgcgtttcattactccgaagatggagtggatgatttccatgtatacgtttctatttgtgtttgcgttgtccttctattgcctggagaatttgccgatacttgatttccgaccttacagaattggagcgaatatcaaggcgggcatggaaattccggaaggtgctaaaccaagcgtgtttgaaagccggttcattttggaaaaaggaggaaagcgtcaggaatttacattggacaactatccggacagtacatggacgtttgtagaatcgcgtacgatactgaaggaaaaaggttatgaacctcccattcatgatttttccatgatgagtctggatacatgggaagatataacggacagcgtactgtcggataaaggatatacgtttctgctggttgcccatcggatagaaggagcggacgacagtaacatcgaccttatcaatgaaatatacgattacagtgtggagcatggttatggcttttatgccttgacttcatctccggaagacgagatagaattgtggcgtgacaagactggagcggaataccctttctgccagacagatgatattacgctgaagaccattatccgttcaaatcccggtttgctgttggtaaaggacggaacaattttgaataagtggagtgacaaccggctgcctgatgaatatgtgctgaccgatagcctggacaagttggaattgggcaagcagaagcaggaaagtgacttacaaacaataggctatgtgttgctgtggttcatccttcctctgatgatggtgctttgtgtcgatattttagtcgtaaggcgccgggagaaacaacgcctcagacaacaatagtatcaaatagtaaatagtaaatacattaacccttttaataataaaacaaaatgagaaaaaacattgttgcaggaaactggaaaatgaacaaaaccctccaagagggtattgctcttgcaaaagaactgaatgaaacattggctaacgaaaagcctaactgtgatgtaatcatctgtactccgtttatccacctggcatctgttactcctttggtagacgctgccaagattggtgtaggtgcagaaaactgtgcagacaaggagtcaggcgcatataccggcgaagtatcagctgctatggttgcttctactggtgcaaaatatgtcattctgggtcactctgaacgtcgtgcttactatggtgaaacagttgctattctggaagaaaaagtaaaattggctttggctaacggtctgactccgattttctgtatcggtgaggtactggaagaacgtgaagcaaacaagcagaatgaagtggtagccgctcagctggcttctgtattctctttgtctgccgaagatttctccaagattatcttggcttacgagccggtttgggctatcggtaccggtaagacagcttctgcagagcaggcacaggaaatccatgctttcatccgttcactgattgttgaaaagtatggtaaggaaatcgctgacaactgctctatcctttatggtggcagctgcaagccctccaatgcaaaggaactgtttgccaacccggatgttgacggcggtctgattggtggtgctgccttgaaggtttctgacttcaagggtatcatcgatgcctttaattaaatagttgaaagctgaaagttgaaaattgaaaatggattgcatgttgtatctgcatgactgtttttcattttctattttccattttcagctttccattttccgttatataaagatattgactcatgaaaaagcttggtttacttttagttgcatgtttcgcttttgcaacgatttctgtagcgcagaataatattgtgaaaagcctggaacgtaatgtgccgggacaaggcaaggtgactatccatcaagatgcacgcattgcggcattgataggttcggagtatgttcctgccggttcggatgagcagaaagtgattaaaagttcgggttaccgcatacaagtttatgcagggaataatacccgtcaggccaagaacgaagcttatgcggtagctacccgcatcaaggaacattttcccgaacttacagtttatacctctttcaatccccctcgttggctgtgccgtgcaggagatttccgcagtatcgaagaagcggatgccatgatgcgtcagttgcgggctactggtgtattcaaggaagtttctatcgtgaaagagcagataaacatccccttataaagaattatcatgttaggaaaagaagaaattgtatctccttcattagatgaattgaaggaacattatcaccgcatccttactctgttgggtgaagatgccggacgtgaaggtttgcagaagacacctgaacgggtggcgaaggccatgttgtcgttgacgaaagggtatcatatggacccgcacgaggtactccgttcggccaaatttcaagaggaatacagtcagatggtgattgtgaaagacattgacttcttctcgctttgcgaacatcacatgcttcccttctacggaaaggcacatgtggcatatattcctaacggctacattaccggactgagcaagatagcccgcgtagtggatattttctctcaccgcctgcaagtgcaggaacgtatgactctccaaataaaagagtgtattcaggagacgctgaatccgctgggggttatggttgttgtggaagccaaacacatgtgcatgcagatgcgcggagtagagaaacagaactccattaccactacatccgattttaccggagcattcaaccaagcgaagactcgcgaggaatttatgaatttaatcaggcataattcttgacggagaactccccgaattgaatttaaaaattcaggatgactctgtctcccagccgctttgccatgatgctttttactttgttcaattcgttgtagcgctccatgatgctgttacactgggtttcatcattggctatggcagggttctgtaacgcaaatagggtatgcttcaattcttcgcagacgatggcatatttgaagtttatcattaaccgtggaattagctcatagaggcgttcttcgtccgttaccatttgttctatctgtgatttccttaactgatagcggttgctgataagctccacactcagcttgctgatgacggggtcgggatgcgccacaaaataccgttcggcggtaaaaccctcattgtggatacgttcggcagcctctgtcaggatttgccggtgaagcggattgtggaaggcaagttcgtcttcttttaaatcattgactatatattcagttacagtgataggggtttcctgcccctcttcattggtgacattgcacatcacccgctcaccatagagcactaccatcttcagaataagtcgttcgtatttatagaactcctggccctccttaccctcctgcgggatgaaggatacatattcttcctcgggtggaaaaggtggaggtgtttcggaagggagaccggcaggcagtgattgggacggatagccagcttgttgtgcgtcggggttggtagctgcagtatgactgccattgacccccgtttctgcattggctcttgcggcattggccgaccgacgctcacgttctgctcgctcagcttgttgctcggcttgcttttcgcgacgcttggcaacctcagaaaccagcagtttatcttctacgtgcaataattgggcgcactccttgatatagacatcacgcacaatggcttcgggaatgatggaaatgctctgcacaaggtttccgataagctcggcacgcttgatggggtcttttccagcatcttccagcaacagattggttttgaagcggataaagtccgtttcattctcttgtatgaaggcctggaactccgtcgcattgtgtttgcgtgcaaaggagtccgggtcgtcaccatcgggcaggaggcagactttgacgttcatgccttcttccagcaacatatcaatacctcggatagaggcctttataccggcagcgtcaccgtcgtagagcactgtcatattgttggtgaaacgatgaatcatccggatttgtccggatgtcaatgctgtgcccgaagaggcaaccacattctctatgcccgattggtgcatggaaatgacgtctgtataaccttcgaccagaaaacaacggtcttgtttcacaatggcttgtttggcaaaatatatgccgtacagttcattgcttttatggtaaatctccgattcaggcgagttgacgtacttcaccttgacgcctttggtggcgccggcaagcacacgtcccccaaaagccaccaccttgccggagagagtgtgtaccggaaagatgacgcgcccccagaagcggtctcgcagtcggtggtcgtccgtctcgtagcagaggccggtcttgacaagataatcctttttatagcctttcttcaaagcttcctgggcaagggcatcgtggctctcggtacaatagcccaactggaacttctcgatgatgtcatcccggaagccgcggctgcggaaataggccatgccgatactccgtccgtctacgtggttctttaggatattctggaagtagtcacgggcaaagttgttcacaatgaagaggctttcccgttcaccctgtgctatcttctcctcgctggatagttcgcgttctttgatttcaatgccgtatttttttgcgagatatttcagcgcctcgggataagacatctgttcgtgctccatgatgaaatgcactgcatttcctccttttccgcaggcaaaacacttgcagagccctttggcgggggatacatagaaggaaggggttttgtcatcgtggaaagggcacagacctacatagttcacaccgcgtttgcgcagggtgacaaagtctgatacgacatcgtatatctgtgcggcatcaagtatgcggtctatggtgggttggtctatcattgtctcttttctaacttgtgcaaaagtacatgatatttcttggataatcaaaaaatatcatataggaaagagcagaccggaactctacatcatcataaaattcccgtggattgtatagtcgagtttttctttcaatctttgtatgtcaaccggcttggacatatatccgttaaagccattctgcataatcttttctttgtccgaagcaaaggagtatgccgttactgcaatgataggtaccgttttggatactttacgtatttcgcgagtagcttcatatccatccattttaggcatattgatgtccatgatgaccacatgcggatgaaacttctgatggagttccacggcttcctccccatcccaagcatgaaccaactcataatctttctgtaggatagacttgaacagcatatagttgctttcgttgtcctctgctatcaggattataggcttttccttgcttctctcgttcagaagaggcattaaagttagattattttccttttgggcctcttttggtttataaggtattgtaaaccagaaagtacttcctttaccttctccttcggattctactccgatgcgtcctttcatttttgtgacaatgtttttgcatattgagagccctaatcccgttccttgtataaaggtgtttactttggtaaaccgttcaaatattttcttctgattctctagtgatatgcctatgcccgtatcttttacgtagaaatagagttcttctccacggattttgtatccaaacataatctcacctttctctgtgaattttgcagcgttgaccagcaggttgatgaggacttgagagagacggttatgttctgtctgtacataacaaactggtacttcaggaacgaattgtagggcaacacctgtttgcagtctgcctcgtacagtgttttgcacatcttttgccaactgatttaagtcgacattctgataattgaattccagtgtatttgcttctatttttgaaagatccaggatgtcacttaccagttgcaatagcaactggttgttggtttctatgatactgatgaactctttgcgttcggtttcgttttcggttgcagtcagcaggctggagaatcctacgatggcattcaagggggtacgtatctcgtggctcatattggctagaaatgcagatttcagccggtcggattcttgggctttttctcgtgctcggataagcgcttcttcttgcctcttgcgttctgttatcagtaaaagggagccgacaagcgatattggatagccgttcttgtcgcgctggtcaattactgcgttggtttccatccaatctgttatttttcgcccttctacttcggtgatgatacgatattcttctttgatatgctgcaacttgcctgaaatgagattttcatgtacatggtgcatacgttcgaagtcttccgggtgtatctttcggaaatattctgacgccttgataatatctacttggactgtagagttcttctcctttgtaaagttcatgtggtctaatatcttttgtgcttcgcaataaatcagaccctcctttaaatcccagcgccatggtatgatgcgtgctatgcccaatgtcatttccagttttttattaatctctcgcaatgtgttttcggcatctttgcgcgctgtaatatctacggcaaagacatccaaagtgtgtttttgggatgccgggcaaagaatgaattcgtaaaagctgtttgtttgtttgaagtaatgagtaaatgttaccgtttgcttttcttggaataccatttccatgaaatgtgtcaggtgctctatttgggagaaggcatttttctgtgaaccatcggtagttggcgtaaactggtcgttgaaaataatattgccgcatcgatagctcatatctgctatctgtcccgttttgtcgaagaaaacctctatttgagtataagatatcggcatattacgtaaaagggtatcatgggcacttagcaaggtgattttcttttgctggaaccggtaaatgactaaagctatgataagtagtgagagtatcaacactactccgcaaataatccaccattggtacttctgccagaatgtaagcggtttattgatgaataccgagtctttaggacagagtgtggtgtccagaccatccatctgcagttgctggtagttgatgaagggataggatttcttgctatatgtaaatgggatattccgtgcatcctctcctgcaaatatctgtttgagggctgaagaaagcgcgttttgcacttccatgcggtcatagaaatatcctcccgcaaacccctctttacccacataggcattccttaatgcaaatacgggttgaggcgatgatgcaactaactgaaagtctccactgatgagtgtaggaaaaccgagtagattcttacgctcgtaaaaccatgtggaaaatagcatacccgtctccggttcatcatttagcagatatgcctgtaattcgttttggtttctttcattacctattaagcgttcatagtggaggtttggatactttgacgttatataggcatgaataagccggtccaagtcttggttatgatagagttcatctgctgcgaatacaatcgttttcatttttggcagcatctgtaccatcatgtcgatggtctctttgtacatatacggcgtttcgataaaagtaaagttgtattgcggctgcaggtcaaccagaggagatgtgatggcattggaaatgtgtataggacgtccggtgaaataatattcccgtggagcatacgtgtcttcgttgccgatcaatactattggaatatttccccactcactcaaaatacgttcccttaaagtaaaagccatgttgccgagaagtacaagataatcgggtttcttatcctggaaacgttcgaaaatgccattctccatccggatatacaatgagtcattacgaatgaacgtcccgttcatgtgtactacatcggctgtgatgtcctctataggagatgtttgcagcaggatgggagttataagttcttggctccagggtgcgctttcattgtacgagtttataataagtaatctgcggtgtttgccgactatggttgctgtggcaaaagccgaacttaaatataaaaaaaggaaacataaattgattatgcatcttttatctagaaaaattttcataacctgatttttcaagtagtatattgtctaatggcaatttaattgccacgtgttatttatacaaaaataatacaaatgcattttaatcgtaaaatatagttgctaaaattaaaaataattaacggcgtctttttattctatacactggaagtttaatgtaattattattttatatatctgttttgtgttgtctagcaagtgagtacaagggtgagaggagatagaaaaggaagttggcagattgtaataaaaagataaaaaggatattttcatcttgaaaaaagtgatatttttgcacccgcttttgaaaatggtaccggagacatttttttgtcttttagtgtcaactgttaggatttccggtgattcatgcacctcttcaaagggctacttcgacggatagcctgaggtggtgactgtctttttcatccggggtgtttagttgggataaaagtgtgtaccttggcatcgaggcacacacttgttgattgtttatctaatcttttccctgattttagtcagatacttcttcatgccttctgcatccttattgctgatgatttccagcaggttcttcagttccaggcggatgttctccacttgtgagggggtgcgcggattgaagagaatttcctggagcaggtagtcgtcttcactcagcaggcctttggcaatggccatgtgctttttgaaggtggtgcccggagcttcctggtgtttcattaccgctgcaaacacgaaagtggatacaaacggaatggataaggagtatgccacagtctcatcatgctcgtcgaaggtatattcaaagatgttcagcttcatggtctggtagaggtccttgaagaagattttccccaagtggtcgccttcgctgatgatgatggcattctccgtattcagattgttgaggctggcaaaagtgggaccgaacataggatgcgtcgacacgtagcggaagccgctttcatcgtagaatttcttcaatccggtctttaccgaagcgatgtcgctgatgatgcagtctttgggcagtacaggcagcacttggcggaaagcgtccagcgtgtatttcaccgtaacggcattgatgaccagctccggctcgaagtccttgatttcttccagtgtggtgaagcggtaggtgttgtagacaaaacgcagttggtgcggattgacgtcgaacacagccgtctcgtgctggaaactcaggatgtctgtgaagaaagagcccattttcccggctccaagtattaatattctcatgatgtttaatgtgccaattacttatttataatttccatctgctgtcttacactctcttcgtgtatcgcctcaaatacctttttgatgaattcagcatccatgccacacaatgcgccttgcgagccgcgtttctcgaggatttcgttgtagcgtccggtttgcaggatggtcatgtcatgctcttttttgtatgtaccgatttcacgtgccacacgcatccgtttggccagctcctgaataagattgttgtcgcattcgtctatctgcttgcgcaattcgctgaggttctcggtgctttgtgtttccttgcggatgaccagcaggttgaggatgtaatccagcacatccggggtgacttgctgggctgcatcgctccaggcacagtccgggttgcagtggctctcgataatcagtccgttgaagcccaaatccatagcttgctggcagagtggagcaaccagttcgcgctttccacctatgtggctggggtcacagataataggaaggttgggaattcggcggcgcagctcaatggggatatgccattggggcaagttacggtagagctttttgtcatagctgctgaatccgcgatggatggcacccagacgtttcaagcctgcattgttgatacgttccaaagctccaatccacagctccaggtcaggatttaccggattcttcaccagtaccgggatatctacgcctttcagtgcatcggcaatttcctgtacggcgaaaggattggcggtggtacgtgcacctacccaaagaaggtcaattccagccttcaggcattcgtatacatgtttggcggtagctacttctgttgaaacgtacatgccggtttctttctttacctccttcagccatgcaaggccgtctacgcctactccttcgaagccgcccggtttggtgcgcggtttccagatgccggcacggaatagcttgaggcctttgtctgccaattgtttggcggtgctcattacttgttcttcggtttcggcactgcaggggccggctattaccatagggcgtttgtcttcaacaccaggtaatgtgataggttctaattcgagttccatattctttatttgtttaataatattctttaattatgctttttcttccttgtgacgtttcctccttttcagaagactttctgagcaaggtcccggagatttagtaaaacgtcggagaagatttactaaatcgttcctcccgttttagtaaatctccggtggagttttagtaaacgggattccggctttagggtgttcatctcttacttgtaagcatttatttcatgtccttgatacgcttcaatgcttctgccagtttattgtccttacagcagagggagatgcggatataccgtttcccgttacttccgaagataaacccgggagtaatgaacactctggctttatgcagcacgtgttcagtcagttcttccacgtctgtacagctgtcggggattttgccccagaggaacatgcctacctggttttcgtcgtaggtgcaacccaaggtatgcatgatttctcctgccaactgacggcggttgcggtaattcgcgttgttgccgtcataccagtcttgctctgcttccagggcagtggcggctgccagttgcatggcacggaacataccgctgtcgatgttgctttttactttcaatatccattgcacgaagtcggcattcgaggcaagcatgccgatacgccagcccggcatgttgtggcttttgctcatggaattgaattctatgcagcactctttggcacccggaatgctgaggatgctgataggatgttcgttcaggatgaaactgtaggggttgtcgtttacgatgacgatgtccttgcggcgtgcgaagtccaccagtttccggtacagttccggtgttgcgttcgccccggtgggcatattgggatagttggtccacatcagttttacacggctcatgtccatccgttccagttcgtcgaagtcgggcatccagccgttttcttctttcaagttatagttcacgacctcggcacccagaatcttgcttaatgaagtataggtgggatagccgggattgggaaccaatacttgttcaccggggttgacaaaggccagcgtcacgtgtaggatgccttctttggagccgatgagcggttgtatctctgtgttgggattcaatgctacaccgtaccatttttggtaccagtccgcaaaaccgcggcgcagttcggggatacctacgtagggcatgtaaccatgtccgtccggattgcaggcagcttcgcaaagtgtccggattgtcttttcggaaggcggcatgtcggggcttccgattcccaggctgatgacatccattccttcggcattcatttgtgccacttctttcagcttcttcgagaagtaatattcgcttacgcttgccaggcggtcggcaggctttattctacacgtttgattttccatcttcatattctcctaatattttcagctctttggtcagcggtgtgatggccgcaatggattgtttatatctcagtacattgtcgaagacgacatctacgtaaaactggtattcccattcacgcccgatgatgggcagtgattgtatcttggtcaggttgatgcggtagaaagacaaaatagacaatacttgggaaaggcttccttcagtatggggaagtgtgaataccatgcttgccttgttgacgtccttgctgcgatgccggttcagttcatctacttgccaagggtcggctacgaccaggaaacgggtgaagttatgtttgttggtttcgataccttcctgcaggaccttcatgccataacgctctgcagcagctttggagcagatagctgcatggcctttcagatgttcctgttggatgatttcggcactgcgggcggtatcttcgccttccaccactttgattccggggtgttgtcccaggaattcacggcattgcatcagggcgatagggtgggagttgacttcggtaatatcatcccagtcttcatcgggcaggcagacaaaactatgggaaatacgcagcttgtactcgccgacaatctgtgcgccactttggcgtaatagctcattgttatgcagcaaactgcctgcaatggtgttttctattgccagcattcctatggtctgactgtcttttttgatggcaccgaacacgtcttcaaagttggcgcaacagattaactctatttcttctccttcgaagtacttgtgtgcggcgatgtcgtgatacgagcctaatgttccttgaatggctacctttttcattatttttattttcttggttatgctataaaaaaaatcccgcttccatacgatggagcgggattctgtatatttacttgtttctctattcagtccttaagcatcactgtcacttgatacatacaaactcccgctctactttctggctaaagtaaaagtaaaaaaagaagtaatatgcataagtaaatgacttcatacttgtattctctgtttttgaattacgtgacaaaagtaatgcttttcttttatatacaaacaaaaaacaatgttttttttagggatagtagcaatttaacttatttccctttaacttgtacaatgacttgaaccggacgatggtcggatgaaatggtgtcttctatgactttccggtattgtacgtcaaaccgatacccattcttggaatagccgtagatgtagtctatacatcggttgggacggtctgccgggaaagtataagaggttgtgtcattgagggtggcaaaatgttttgccaattccagctggggagcgcttgctggtgcagagttcatgtcgcctgccataaagatgggcttatcgacgttttgcaaggctttttctatcaatggtacggcaaggaactggtcttctggagtgagggactggtgtgtggcacaaaatacataatctttaaattctgcaataatgagggtacgtttttcttcccgtccgggcattggaatgattttgtattttatgggtatctctctggagaggattccgatgccgtagcttccaccctgaaaaggaatggctgctgcataagtcccgtgcattccggtcagtttttctagttctccgagagcatggattcctttgttgcgcaccgtaacactgtcaagttcctgcagggcgactatgtccggagaagtttgactgataacattggcaatgcgtcggtaattgtactccttgtccataccgatgcaattatgtacgttataggacaatatgttcacttgctgtgcatgggcaggtgcgaacatcagtacaaaaagtactgatagaaataaatttcgtttcattggcggcaataattgaatttgttataatcctaggatattaccggtacttccccccggttggttaccatattgtccgttaaagttctgtatctctttaggattgagttccagtcctttcttcatgtcttctgcagaaccttccttgtcgccgttcagcaacttggcacgtccgcgctcatgataggcctctgcgaaattagggttcagttctgtggcttccgtaaagagctcgatggcttctgccagcttgttttgggtgatgtaaagctgtcctaagtagaggaaggcttgttcgttgaagggattcaactccgtcactttctgatagctgctttctgctttttctttgtttcccgtagcttcttctatctttccgcggagcaagatggcactttcgtcttccgggtcttgtgccagaatggtgtctatgtcttccatcgcttccttgtattgctgcatttggaccagtgcttcggcacggagcagacgtgcttcgatgaaatcatctttcagtacgatggctttcgtaagatgagcgatgcacatgatgccgtccccttgcccattgtctgctttgcctagcaggtagtgtgccatggcgttgccttcttctatttcgatagctttctttgccgctcctgccatggcgggatagtcttcctgcatgtagcatacgttggctagactgaggtaggtggaggtatgttccggctctatttcggtcatacgttccagcagtttgtgtgcctcgtccagttcgttggtctgggtgtagacttgggcaaggtagcccatggtctcaaagtcttcctgaatggcaagggcttcagtgaagcatttgatggcgtagtctgtacggcccatgcgttgtgcacgcataccgtcatacttgaatatctcaaaattcttctgctcgtttttttgtttctcatttgccggactgtctgacttgccggagaaaaaagatttaaagaatcccataggtgattaaaaattaaagaattaaaaattaaaaaggaaaaggaggggcatggctgataagagatgttcctctcagcggcaggacattcttttccaacggcaaaagtaatgaattattttttgatttgaagcattccgttgacagcaattaccttaccttcgtccaacaattcatgtaacacatcgatgagcatgtttttatcgtccggtatctgttctgccaaagtggctggagtttgtggtttatcagatagggcttgaagaatcttttcagaaagttccttttccgaaaggtggccggaaggtttcttgttcttcaaattgatgcaagtgtcgcactgcccgcagttatgctcgttcttctctccgaagtagtgtagcagcattcgactacggcacacggtatcgctgctcacgtaatccagcatggcacttatgcgtttctcataccgctctttgcgttcctcgtacacggcgggagagatttgcaggtggcgcatttcaaccctctctcgcgtgtatattatatatggtgtctttttgcgggggatgtaactgacgatacgtagcttggctaggtggatgagctgttcatacacttgccggcgtgtgagtccagtgcgtatggccagtgaatcttcattgatgaaagcatggtctgtgaagaccccggtataggagcggagaatggtttggatgagtttgtccatatcttcgccgagctctctcagtttataaagttcgtctcgacggatagtgaacagtagccgggatgcattgtcttgttcgtctgtatattccaggtatcccgcttgtgtcagaatcttcaaggcactgtccacgggaacggggaagtacttgaactttcggcaaaagtcttctatattgaactcgcgtacacagccttgtccgtctcccattgccatctggtaatagtattgaagatgctcatatacttcctttatatactctttttcaggaaaggtgccgggaatgcgtttgtgcagtgttgccttatccgacttggcgtaaaggacgaccgcgtaggctttttgtccgtcccttccggcacgtcctgcttcctggaagtaggcttctatggaatcgggcaggtccatgtggatgacaatccgtacatccggtttgtcgatacccataccgaatgcattggtggcgaccatgacacggctttctcctgtttgccagcgttgttggcggatgtctttggtggcgtcatccagtccggcatggtagaaatctgcggtgatgccttcgttgtgcagcagttcggtaatttccttggtgcggcggcggttgcgcacatagatgatggcgcttccgggcatacggcgcaggatgtgcaacagctctcccgtcttgttttccgttttacggacgatataggcgagatttttgcgctcgaaactcatgcagaacacattttcctcacggaaatgcagacgggcctggatatctttcactacttccggagtggcagtggctgtcagtgccagcacgggtacaccgggtagcagtgtgcgtatctcggctatcttcagataggcaggacggaagtcgtagccccattgcgatatgcagtggctttcgtctaccgtaatcatactgattttcatcttctgcagtttggtgcggaagatttcagtatcgagcctttcgggggagatatagaggaacttgaaattgccgaatatacagttctccagtgtgacgatgatttcctgcctgctcatgcctgagtagatggcaagcgccttgattccccgctttttcaggttttgtacctggtctttcatgagggcaatcaacggagtgatgaccaggcaaagtccttctttagcaagtgccggaacttggaaagtgatggattttcctcctcccgtgggcattagtcccaaagtgtcccgtccctcggtaatgctgttgatgatatcttcctggattccccggaaggtatcgtatccccagtattgcttcagaagcctcacccccaatccctcccccatagggaggggagttttgaagttactactgctgctcatggtcttattgaactttcttgctacttcttatcgttgaattgatattctttccttctctatgctaatagtagtgattactaatcttatagcatcaaccaattttcatcatttccttaatataaggagactattcttattcccctccctgtgggggaggggttaggggagaggctttcagttcggctttatgtcttcaatctgcaactgcacttcacccctcttatgggtattctcttcaatggaatagcagatgtcgaaggaacgtttggtcttgatgaagcgtacgtgggaactttgcccgaaagcgatgccgttcattacattgttcgatttattatccaccagttctagcttgatatgttcctggtcgcggcctacgactttgctggtaccataatcatagacattgtgcgtacagaaaatgggtttggcattgtccggtccgaatggattgaatttcttcaagtcgctgaagaatttcggagtgatgtctctgaaatcaatctcggcattgatgtcgatgacggcgcatgtctgttccggcaggatattttgtgatacgaactcttcgaagcgttcgataaaggccggtacattttccaccttcatggaaagaccggcggcgtaggtatgacctccgaagttttccagaaggtcgcggcagtattcaatggctttgtagacatcgaatccggagacggaacgggcagatccggttgccatgtcatccgtacgtgtcagtactactgccggccggtaatagatttccgtcagccgggaggctacgatgccgatgacgcctttatgccagtcttcattgtacaatacgatggaacgtcggtcggcaagtccgtccaggtcagctacaatcttgttggcctcctcggtcatggtcttgtccaagtccttgcgtgtctcgttgtattggttgatttgtccggctttctccagggcaagagagaaatctttttcagtaagcaagtcaacagcttctttcccgttctggatacgtccggaggcgttgatgcggggacctattttgaatacaatgtcactgacggtgatgtccttgtccgtcagtccgcagacatcaatgattgctttcaggcctacgctgggattactgttcaactgcttcaaaccgtggtaggcgagaatgcggttttcacccataatggggacaatatccgatgcgatactgacggcgcagaggtccagtaaagggataaggtgatggaactcgataccgttgttgagggcaaatgcctgcatgaacttaaagcctacaccgcatccggacagatgttcataaggataggtgttgtcttcccgtttggcattcagaatggctacagcagggggcagtacatcatcggggacatgatggtcgcagatgatgaaatcaatgcctttctccttggcgtatgtgatttcttcgacggctttgataccgcagtccaatacaataatcaaacctacaccactctctgcggcatagtctactccttggattgaaactccatacccctcattgtaacggtcggggatatagtagtcgatgttcgaatagaactgttgaataaacttgtagaccaatgccacagccgtggtaccgtctacgtcataatctccataaacaagaatgcgctctttctttcccattgccttgttcaggcgctctacggctatatccatatccttcatcaggaatgggtcgtataagtccggtagttgggggcggaaaaacttccgggcatccgctgccgttgttattccccgctccaccagcaattttcccaatattgggctaattcccaattcttgggccagttgttggcttgcttctgcctgttcgggtgtaatgggttgataattccatttgtgagtcattttatatattattttttctttttctatctcaagatgttgggggagtagaggggttcaatacgtgcacttttctccaacaaggtgtaaaggtatgaaaaactcttgaaacggaggtgaattctgcggaaaaactttataagtatatgtattctccactaaaaaactttatttttgtatccattaaaaaatatcgctatgcttgtttttatctcttgtgcaaagaccatggcagcgcgctgctctgttgtcgtgcccgaagtcacagtcccgaaattcgaaacggaggctgtgcggaatgcgttggaaatgtcgcagtattcagtatccgaattggaaaggcttcttcgggtgaataccaaaattgctgccgagaaccgtttgcgttttcatgatttctgttcggaggagaatcgttcgatgccagccgtttgcgcctacacgggagctgtttttaaacgcattcttccgaaagatttttcagcggaggattttcgttatgcgcaagaacatctacgtatcacttcttttctttatgggttgcttcgcccgctggacggtatcaaaccctatcgtttggaaggagatgtccgtttgcccgaaaaaggtggaatatccatgtttgattattggaagcctttgttgacggattacttcatagaggaaattaaaaactgtggcggtgttctcattaatttggcaagtgctgaaatgaaagatttgttcgactggaagcgggtggagcaagaggtgcgtgttattacgcccgagtttcaagtttggaaggccggacagccgaagactgtcgttatctatgccaagatgtgtcgcggagagatgacgcgttttattgtcaagaaccgtctggagtgtcctgaggagttgaaatccttttcttgggagggcttcgtctgggatgagatacgcagtacggagaatgtatggcatttttcgttaggtacatttatgtaatgaaaaggtacattacgtttggctcagatgttactatatgttgctttcgatgtttgcgcaaaatgaagaactaaatacgcaatttaggatgagggaaaagaatgaactctctacatttgcatgcagtaaacttaaaagcaatatactatgaagagaaacggattaagaacagttgttgtattagctttgaccatatttctattgaatgctccggtttgtgctacagcttccagattgcaggatacttgtgcggaggcgcgggatgaggttgcactgcggcctgagtggatgaggattctccatgatacgcttcctatatgtaagatttctattcctggttcacacgatagcggtagtatcaaaggagggcatatgttgaaaacacaagcaacagatattcctgctcaattacggcaaggcatccgtgctttcgatatccgtttggaaaagaagggtaataaactgggggtgtttcacagtcatgcctttcaggatatatattgggaagatgatgttttacctgcttttatacactttctgcaaacatatccttctgagactttgattgtttccttgaaaaaggaagggggagaattgcgggattatgcttctctgctgtccgtttctttaagcagccctgagtatcaaagttatttcgtgatggactttcgccctgaactgacgctgaaagattgccgtggaaagattcttttcctgcatagggatcatgctatggataattatcctggagcagcatgtgtaggttgggaggatgacagtacttgcctgctcactcttcgcaataaagatggtaaggaaggagtggctttgctcgaagataaatatcaatatgaatcgggtgaggaggccgggaagaaggtaggggtttgtgtccgtaatattgaagggatgtctgctgagccggtttcctcacgtcggtggggaattacttttgtaagtgcgacggggctgcccttgggaacccctaaagtctttgctgataaggtaaacaagcctattgctgactatttaaaacaaaagaatagccggaattgcggtattgtttttatcgattttgtcagtgaacctggaggaaaagatttggtggaatatttgattgacagtaatgtttgcgcaaaatgaagatttatatgcgcaattgggaatactgaaaaaaaagcattttcttaattttgcacatgttgaacaccttaatgttatatactatgaaactgtcaatagatttaggaggaaccaatattcgaatagcccaagtggaaaaagggaactgcttgaataaagtgtcggttccatgtttagctcagcaagatgcttctactgtgctaaaccagctttcccagcttattcggaatatgatgaatgagcaggtagatggtatcggtatcggtgtcccttcaattgttgatccggagaaaggaattgtatataatgtagcaaatatatcttcttggaaagaaatacacttgaaggagattttggagaacgaattcaaggtggcagttgccattaataatgattccaactgtttcactttgggggagagcctatacggcgaaggaaaatcttataccaacatggtaggcgttactatcgggaccggaattggagctggcgttgtcattggccgtcgtttgtatggtgggcaatatatgggagccggtgagataggctcatttccttatttggactctgattttgaacactattgcagtagtttcttgtttaaacgttatggcactaccggtgcggtagtagctgaaaaagcccagcaaggagaacaagctgcattggagatttggaaagagtttgggaggcatttgggtaatcttataaaggcaattctttttgcctatgctccccaggctattgttttaggaggcggtattgtatcggcttttcctttctttaaaaatgctatggaacaaacaatgcaaagttttccctacaagattatatcggataatgtgagtgtggtggcttcgcatcaaaaggattccagtttattgggtgctgccgctcttcttgagtaataatccctatacggtttgattgaaagataataaatatttacagttgtattattttacgcataaataaggactgttagagaattgcttcttttgtaataactatgtaattctgctttctgacctttgtggcggaattataattttctatattataaactttaaattttgaatgcatgaaacaagtaaatcttagaatctatcgaacgattctgaccctattgttgggactgttcttgtcggcaggtgcttatgcacagcagatttctgtgaaaggaacagtaaaggatcagactggcgaacctgtgattggtgccaatgtattagtaaaggggacgactaatggagtgattacggacgttgacggaaactttaatgtttcggccgataaaaacggcgtattggtaatcagttttgtcggctatgtgactcaggaagtaccagtggcagaaaaacaaatggtaattgtgcttaaagaggatacagaacttctggatgaggttgttgtattagggtatggtgcgaatacacgtaagcaggacttgtctgcttcagtgggtgtagtaagtaatactgaagaattggctgctcgcccggtaacttctaccgaaggcatgctgcagggacagctggcaggtgttaccattacggccgatggtggcgacccaacttcttctcctaacattgtgattcgtggtcaaggctcacaagatggagacaatgtactttgggttgtggacggtgttcccggtgcacctatctcatccatgaatgatattgaaagtatcgttgttttgaaggatgctgcttctgctgctatctatggcgcacagtctggtgcaggtggtgttgtgttggtaactaccaaaaaagcgaaacaaggtgctccttcgttgacttatgacggcacttttggtattcgtcaggctaccaatttgatagaaccactgaatgcggagcagcagattgagatgcgtaagatatctcatcaaaatgcaggactttcgcttccagtcggttgggatgttaccaaaaatccatggataggtacgactcgtactgattggatggatgagattttccgcactgccttctaccaacgtcataacgtagcgttgaatgtaggttctgataatttttcaaatcgtatatcttttgcttacgataatgatgaaggtgttttgattaatactttcaagaagaatcttacattacgttataatggtaaaatgcagctgaacaagtgggtgagcgtcagtgaggattttgtatggcagaacactacccaacgttccaaagctacggataacgatgcttatacaggacctatcctttcggctatctacatgccggcaagtgccactgtctataatccgttggacggaagttatggtggtgtgactacggaagatcctgcctatattgaaaaatatggttcgaatttctctgatatccacggggatgctgtaaatccggtacgtctattggaagcagagaatttgtatgacaagataagtgacatatggagcactaccagcttggagatagctaatgtacttcctggattgaagtttacgagtcgttttacttataatatgaagactaatcattacaagaagttcaatcctattcgtgatgaagtaggtaaaccggctttgtcgaataatcttcaagaaactacttaccgtagagatgcttggaagacggaaaataccctgacttatgataagacattcggtgaacatacggttggtgccttgttctcgactacggcagatcattctgaaacgcgtggactggaagtgacgggtaaggattttgcggatgaatcggaatttttacaatacatggcatatgcaggatcagtgacagcatctgactatttgactggacctgatgccaatgtgtcgttgattgcccgtttggcttattcttataatgaccgttattttgctactgcatcttggcgtcgtgattatgctggacgtttgcctaaggaaaataactatggtgatttccctgcagtgacccttggatggaaaatatctaatgaaaaattctttaagaagagtgattttatcagtttgctgaaattgcgtgcttcttgggggcgtgtaggtaatttgagctctatagggcttaattataagtctgctttgttgaagaaaagctcgtggacagaacaagcacaatatggtcctgaggcaaataatatctggaatactttgatttacaacggctctgcgttaaatcctgatttgacctgggaaacttcagaacagactgacttgggcttggatgttgagatgtttaaaaaccgtttgtcggtatcattagactattttgataaacgtactttcaatttgattcagacacaatcaatggggtggccttctactatgggactcgatgccatgttaatcaatcaaggtgaagtgcgtaaccgtggctttgagattcaagctaattggagcgataagattaacaaaaacctttcttatttcgtatcgggtaacttctcgtatttaaagaactgggtatcagatataggtgtgaaggatgcggatggcaatccgggtttgtggcctaatgataaaaggttccgtagcatcccttatatgatgcagagtacggaaggggaacctctgaattccttctacttgattaagacagatggtttgttccaaagtgatgcagaagttgccgagtggaatgctaaacatggaacatatgtgaccaatgataatggtgaaaaagagtgggtaggtattcagccgaatgccaaggctggtgacttgaagtttgtggatcataatggcgatggtaaaattacggatgcagaccgtcagtatatgggtagtgcgactccgaagacgacttttgcctttacattgggaatgacgtggaaaaaactttctttcagtgccatgttccagggagtaggtggagcaaaagctttatatgtaggaaagtacatgctgttgagtgatgtagaaggaaactttaaccgttccagcgagatattgaatgcttggagtcctacaaataccggttctgatattcctcgtttgtcaaagaatgacccgaatggaaactttacgactgcatctgattggtatttggagaatgcttcttatctgcgtttgaagaatgtaaccctttcttatgatttaagcgatgtattccgcaagtggtctcatttgaatgaccgtaacagccgtttgtctgtgtacttcagtggtgaaaatcttgctactatcactggatattctggcatggatcctgaatgtggtggctgggatgctttgaaatatccggtatctcgcgtattatctgttggtgtaaaattgacttactaataattaatagagaagaatgattatgaaaaaaaatatattattttttgcgatgtctgccacattgcttatgagttcttgcagtgacttccttgatgtgcaaccagagggagatgctactacaacgacttattttaccaatgacctgcaggctattgatgctgtagatgcattgtatgaaagatttcatcaggaagctgtatatggacgcgaactgttttgggaacaaggtgccgcgtgcgacgttgtgtggggaaagacccgtgattttccaacacttgctacattgaaatatacaggagacgaatcccctttgcgtactatttttgatactatgtacaaagtgatggcacgttccaactgggtaatacaagagttgcttaagaaagggaaaagcaccactttgagtgatattgaaaagagaagtctcggtgaagcttacttcactcgtggatgggctcatttcttgatcgcttatcgttacggtcttgatacacaaggggtaccttttgtccgttatgaagattttgaaggtggctatgacaattctattcctcctcagcaagcttcggtcatcgataattataaattgattatctcggatatggacaaggcaatagagtatttgccccgttttgaagagtatggagataatgatagaggacgcgcgcacgatgcggctgcagtagcttttaaagctaaagtttatgcttattgggcaacttgggatgctacacaatggggaaatgtaatcagtatggtcaatgaactggaaactgcttacggacgtgatttagccggtacttatgaagagttgttctcttctgatttctctaaatggtggaataaagagtatatttggactattcctggaaatggtggctctcaaggtggcggttcggagtttccgggagttgtccttgagaacaaaggctggggacaatataatggctggggacagaacaagccgtcttatgatatttacgaagagatgttgaaagacggagctggtaatgaccgtttggttcgtacggttttagagtatggtcaggaatttcaattcttgggtgaatcccgtgctttttattcaagctcggatattgaatccggttttatgattaataaatacatggatccctttaagtatgaagatgcagccaataaggggtatatcaatacaaacggagactggccgacagtacgtattaatttcccggttatccgttttgcagaaatgttacttttccgtgcggaagcttatttgatgactaataaagcggacttggctacggctgatttgaatcgcattcgtaaacgtgccaatgttgcattattgacgggcactgctactatggctgacctatatcatgaacgccgttgtgaattggcatttgagtttacagaccatttatatgatttgaaacgctggtatcgctcaggcaatactgaaataaaggctttggctgctgccgaattgaatgcccgtccgcgcgtacgtcattatgccaaccgccaggaccctgcttccacattcgttgtaggtgagtatgaggattatacggataagattgcttatcaggattacatgatcgtattcccttatccttcggttcagattaccaaatctgatggtaagttaaaacagaatcctcattatgattgatattttctctgaaagagataaaatataaaaaaagacctcattgccattggtctaatctgcaggggttggtattttcgggtattgatccttgcagatatttcttctttttctttcatttgcaaaggctattcataaaatcattttaatatacggagaggcggcattcccgacagtctgcagcgctcttcaaatatacagtctgatgaaattaaaaactcttatatgcgcagctgctgcgttcttggcttgctgctcttgtacgtccggtgaacaatctcccgtagactatgtagacccttttatcggtaccggtttccacggacatacctatccgggagcaacagtgccttttggggcagtgcagctaagtcctgacacgcgtgccggaaactgggatgcttgttcggggtatcattataatgatacgactctaaaaggtttttcacacacacatttaagtgggaccggatgcattgatcttggggatatactgtttcgtcctactacgctgaaaccggatttgactaccgaaaacatttaccagccggcggctttttcccataaagacgaagatgcttctgccggatattattcggttgttctgaaagaagaaggaataaaagctgaattgacggtaacggcacacgccggtatgcaccgctatacgtttccttccggcaaagaagcatctattattatagatttgactcatttgcttgataacgaatatatttatgaggctgaacttgaacagactgccgccaacgaaataataggtatgcgcagaaccaggggatggacggacaatcagtacgtttattttgtagcccagttctcgaaaccttttcaggccatagactttatacagaataaaaagatggtttctgcaggagttaagttgatcggtaccgatttgcaggcttgcttgtccttcgataatagtaatggagagccggttatagccaaagttggattatccattgtcagtgaaaagaatgcacgtgagaatttggaaaccgaggtgataggtttcgattttgatgccgtgcgtagtgctgcccgttccgcttgggaacaagctctctctgctattacggtagaaggcggcaatacggacgacttgaagaatttctatacagccatgtatcattctatggttgtacccaatgtcgtgagtgatgtcaatggtgagtaccgccgtcataatatggaggttgggcaactgccaaaaggtaaagtgcaatattctacattttcgctttgggatactttccgtgcatggaatccgttgatgactttgattgatacaactttggtcaataatatgataaattcctttttggacatttacgaatcttcgggtgaacttcctatctggccgctttctgccggagagacgggaactatgattggttatcatgcagtgtccgttatagcagatgcttatatgaagggtattagaggatttgacgcggaaaaagcgttggaagctatggtagtttcttctgaaaagaacaaaaagggagccgattactatattcagaatggctttattccttctaatataaagaaagagtccatctcttgtttgctggagtttgcctatgatgactggtgtattgcacgtatggctcaggaaatgggtaaggatgatatttatcaaaagtatattcaacgttcccagaactatatcaatgtttttgatggtaatacaaaattcttccgccccaagcggatggatgggaactgggaaactcccttcaatcctattgaggtaggtcgtgcctatacggaagccacagcctggcagtatcgcttctttgtacctcacgatgtaagcggtatggcacaactgtttggtggtaagaaagagtttattaccgcactcgattctatctttacagtagagtcggatgtacatggcgatttagtggatattaccggactgataggtcaatatgttcatggcaatgagccgagccatcatatcgcctatctgtacgattacgtcggacagccttggaagacgcaggaaatgacacgccgtctgctccatgaaatgtacgctcctacgcctgaaggaatcattggtaatgaagattgtggacagatgtccggttggtatatattatccagcttgggtatttattcagtttgtccgggaagcaatgaatttgcactgactactcctctatttgagaaagcggttgtcaacctggcaaatagaaagactttgaccatccttgccaacaatccgaagaagaatgtctatatcacaaaagtagaattgaacggacaaccgatagatgtaaattttattacttatgcacagttgatggaaggtggagaacttcgttttactttgtccgataagccgaatatggagagaggtgtttcctctgaagcatccccttattcctatactaaagatgaagtcgtttccattccctatgtggataaggatttgaacttgtttatggataaggtaacggttgcattggccacaacaaccaaggatgccgaaatcagatatacattggatggcagcgagcccacagagcagtcggcattgtacgagcagccttttgaactggacaagaccactttaataaaagccaaaggattcaaggaaggtctccgctcaagcagaacattatccatatcggcaacgaaagctgaattaaaggctgctctttctgtaaatcctactcagaatggtacatcttataagtactttgaaggcacttaccagaaagtggctgatgtagaaaagtcaccgttgctggagtctggtgtcatgcccgaaccttctattaagggtgctaagcaggaggatcatttcggttatatcttttctggattgataaatgttcccgaagatggggtctatactttccagacccgttcggacgatggcagtgtcttgtacattcacgatgagcaggtagtcaataatgatgcttcccatgctgcaattcctgctaccggaatggtcgcgctgaagaaaggttttcatccttacaagctctattactttgaagattatgaaggtgagtatttgagctgggcttggaaactgccttctgccgagaagttggcacccatccctgcatcggctttatttgtgaaataatagtttaatatatatgctatgagaaagttatttttgttatttttacctttgttcgctgcatcatgcggacaggtgaagcagcaggcacctgcaccagagcccgttaatgtcatgagtttcaatattcgctatgacaatctggaagatagcttggacaactggcaataccgtaaagaccgcgcggcaaatgccatccgtttttatgatgtggatatattgggtacgcaagaagtacttcataatcagttggaagaccttaaacaacgattgccggaatacggagtcatcggtgtaggtcgtgaagatggaaaggaaaagggtgaatatagtgcactctggtataagaaagatcgtttcaacttgctggattctggctatttctggttgagcgagactcctgaagttgccggttccaagggctgggatggagcttgtgagcgtatcgcttcatgggcaaaactgcaagataaagtaagtggcaaggagttcttcgcattgaatacccacttggatcatgtaggtgttgctgcacgtcgtgaaggtataagccttatgctggataaagtaaatgagttgagtggtaacttacccgtagtagtaacgggcgactttaatgctagtccggaatcggatgtcatcaaacacgtgactgacccttccaatccggaacacttgacagatgcacgccaggcatcggcaattgtttatggtccggcatggagtttccatgatttcggaaagattccttacgataaacgtccgctgattgattacgtttttgtacgtaatggactgaaagttttgaggtatggtgtattggctgaaacagagaataatgctttcctctccgaccatgcccctattttagtaacagttgaataataaaacaataattatgactaagatattaagaatatgtatcgttatgctcttggcagtcttgctactgccggtagagttatcggcacaaagccgccgtgataaagaacagacctatgttttggaccaaccttatgaggtgacaaagattacccctccccagggcaagaagataaagaatgtcatcttgatgattggtgatggcatgagtcttatgcacgtatattctgcctggacagccaatcgaggcaagttgtttttggataactgccaggtagtgggtttgtctaaaacctattgtgccaacaagctgattacagactcgggagcgggtggaacagccatagctacggggcggaagacaaactatcattctgtgggtgtagataccgaaggacgtcctttgaaatcattggtagacctggctgctgctaaaggtaaatcgaccggtatagcggtgacttgccgtctgtgggatgccactcctgctgatttttgttgccataacaaggatagggatgcggaagctgaaatcgtagcagattacgttaattgcagtgccgattatgtattcggtggaggtgccaagcttttcgaaaaccgtgaagatggacgtgacttgtttaaggaactacgcgataaaggatttcagactcctcgcagttgggatgaattggctggcataaagagtggtaaggtatttgccgtaccttatcccgtcgatactcctcttcctgctgaacgtggcgaccttttggcacgtgcttcattgaaaggtatcgaattgctggaccaaaataaaaacggtttctttatgatgatagaaggttcgcagctggatgactacggacacttcaatgacattgatttgctgatgcaggaaacacatgactttgaccgtactatcggtgccatttatgaatgggctgccaaggatggagaaacattggtagtagttactgcagaccatgagactggtggacttacgttggttgatggagatttggcagaaggcagaatcgtatgtaagttctctaccggtggtcatagcggtgtaatggtaccagtgtatgcttttggtcccggtgcagaggagtttacagggatttttgaaaatactgctatctttgacaagataaaaaaactgctcaatttgtaatttaaaaaataactatttcctatgttgaaacacattttattggtaagcttgctttctttttccactctccctttgctgaaagctcagagctgtggcaatgatgaaaagtatcatttgccttataaaaatacatatgtaaaggaaccgctggtcactgaaaatgagtatcgtgtggcaaaacctgagacgattgtgccgaaaagcttcgaagaagctcggcagattcttcccaatcccatttggggtggacatgacaaggaacttgaaatgtattggaaggcatgggaaatagctatcggcaatattcgtgctcctcaagcaggctcgggttttgtctcaagctatttggatacagcttataatggtaatatctttatgtgggattcctctttcattctgatgtttgcccgctatggtacccgtttctttcctttccagaatacgctgaacaacttttacgccaagcagcatcccgacggtttcatttgccgtgaaataaaggcggatggtgccgattgctttgaacgctatgatccggtgagtaccggaccgaatttgatgccttggtgtgagatggtctatttccatcagtttggtgatacggaacgcctgcacaagatatttccggtactttgtgcttattataagtggttgaaattgaaccatacttggagaaatggaacctactggtcaagcggatgggggaccggcatggataatatgccccgtgttccgtcggaatacagccctatctacagtcacgggcatatgatttggttagatacaaacctacagcaattatttactgccaatttactacttgagatgggcttttatctggaacgttggcaagagatagaagagtttgaagacgaagccaaaatgctgggaaaatatatccatgacaatctttgggatgaaaagaccggtttcctttatgaccagtatgctgacggtacgctctgtacaaccaagggaataggtgcctattgggctctgtttactgatgtattggattctgtacagttggaccgcatggtgaaggaattggataatcctgccacattcaaccggaaacaccgtattccttctttgtctgccgataatcccaagtacaaggagaatggccgttattggcagggtggcgtatggccgggaactaattacatggtgatgcagggccttgtgcagaaaggttatggtaaactggcacgggagatttgtttgaatcattatgcccaggtgtttgaggtctataagaagactggaactttttgggaatattatgctccggaaagtgctgagccgggatttatggcaagggataattttgtgggttgggcaggacttcctcctattgctgaattgatagaatttattatcggtattcggggagattatgccaaaaagcagattatctgggatatgaatttgacggagattaacggcatagaacgctatccttttggtcccgaagggcttatctccttaaaagctgaagcacgccgttctgcaagtgatgaacctcgtattacagtagattccaatatcgattttgaactgtgtgtactctatggtggaaaagagaaaaagataaatgtgacatccggtaagcatacctattaaagaagaaatcaatcatgaaaaacaatatgtcaagacgccaatttctgaagactggcgggcttgccttggctgcaatgacctttcagcccgcttccgtattatcttcatccgggactttcagccagagatatgtttcgttgcgtccttctgcaagcaaaaggaacttcatttcgaaggcagtagatgctgccattgaagaagcaaagcctaaaataaaggacgagaagttgcgttggatgttcgagaactgttttcccaatacgcttgacactactgtcagatatagagtgaagaatggcagaccagatactttcgtcattacaggtgatatagatgccatgtggttgcgcgactcttcagcgcaagtatggccctatctgccgttgatgaagaaagataaggacttgcagttgatggtggcaggacttgtcaacagacagactgaatgtatcttaatagacccgtatgccaatgccttcaacgacgggccgttgggcagctattgggaaaccgaccatacacaacatatggctaaggaactgcatgaacgcaaatgggagatagattctttgtgctatcccattcgtctggcttatcattattggcaatacacggaagacacgtctgtgttcgatgaaaattggcataaagctatgctgctggtggtcaagacctttaaagagcaacagaggaaacaaggcttaggaccttatagctttacgcgcgattgcgaccgccctacagattcgcagattaacaacggatggggagcaccggtaaagccggtcggcttaatcgtttcttctttccgtccgtcagatgatgctacacaatacggttttctgattcctgctaatatgtttgcggttgtgtcattgcgccaattggctgagatagaggataaagtttatggaaacaaggacttctccggagaatgtataacattggcagatgaagtggatgcagctatccgtaggtatggtactttcaatcatccggtttgtgggcgtatttatgcttttgaggtcgacggttttggtaacgcgctttgtatggacgatgccaatgtacccagtttgctggctgcgccttatctgggttattgttcttttaaagatgcgatttatcagaatacccgtaaaatgatatggagcggcaataatccttatttctttaaaggaaaagccggtgaaggggtaggaggccctcatgtgggattgaattatatctggccgatgagcatcattatgaaggcttttacaacggatgattccgaagaaatacgtgcttgtctgaagcaacttcgtgatacggatggagggacgggctttatgcatgagtctttccattcggaggatgccgcggactttactcgttcctggtttgcctggacaaatactttgttcggtgaactgatactgaatacaatcaaggaatatcccaacttattatcccaaatactatgaagataagatattggttactggctatgtcattcatttttctctcttgtgggagagtggctgatgatgtagaggcaaactatggtattatacccatgccgaatgaacttgctccaatgcagggagtgtatgtcttgcaagggaaaaaaacagtggctgtcccttccggggaagccgcgatgaaagtttttcattatttggaggatgcgttgaaaaacacttctgtaacgctgaaggatatttcggaaacgggaaaggccgatatttgcttatctatagataattccttgcccaatgaggcctatacattggaggtttcttccgataggataaatatatcttccaatgaaactgccgccggatttttttatggtgtccagtctttgctgcagctcatgccggcagccatttatgatggtgaccggaaatacgaaggaaagattaggattcctgctgtcagcattacggatgctccccgtttccctcatcgtggggctatgatggatgtagggcgtaattttctgccaaaagaggaagtgctgaagtttcttgatttgatggcattctataaattgaataaattccattttcatctgacagatgaccaaggatggagaatagaaataaagaaatacccgaaactgactgaaataggttcttatcgtaaacagactcagataggacactctgattattattttccacggcgttacgatggaaaagaaaagagaggctattatacgcaggaagaaataaaggaaattgtgaagtatgcatccgaccgtttcattacggtcattcccgaaattgaaatgccgggacatgcatccgcagcactggcttcctatccggaactttcttgcggactgggaaagacttatgtggtgcgtgattattttgatgtttttgatgaggtctattgtcccaaagagcatacatttgaattcttacaaaatgtgctgaccgaagttatggaactcttccccagccattatatccacattggtggagatgagtgtcccaagaaagcatggaagaagtgtgcccattgccagcatttgatgaagtgggaaggtctgcccaacgaagaagctctgcaaagttggtttatccatcggattgagcaatttgtgaacagtaaagggcgtgacatcatcgggtgggatgagattctggaaggagggcttgcccctaatgctaccgtcatgtcatggcgtggcgagaaaggaggtatcgaagcggctcgccaacggcataaagtcattatgacacccggcaaaaagtgttatttggattactaccaggaaagtccggaatttgccccgttggctatcggcggttttcttccgttggatacggtgtacaattataacccgcttcctgctgaactgactccggaagaacaagcttatataataggtgtacaagccaatatctggggagagtacatacagactcccgaatattttgaatatatggctttccctcgtttgctggctatgtcagaggtgcaatggacacagccggaacataaggacttcgagtcgtttgcccgtaggctggataaggagtttgaacgattggattattgcggagtgaatgcttgccgcaacttctatgaagtcaatcaggctggtgcgtggaacaagtcgcagcagacttatgaggtgactttgaacaccttctgtccggatgccgatatttactatgcggtaaatgattcaacggtcaacacttcatcttccctttatgagactccgataccgttggacgaggatgcaactatttattcggcagtttacagaagcggtaagccgctagggaaagtgacccgcaagagttttgctgtaaacaaggcaaccggatgtgactatacttgtaatcctgaagcaggatgggaacacttgaataaaggcttcgggctgactgatggacgacgtggctatgcccgcgacatgcgtcgctggattagcttctaccaggatactgtacagattgtagtggaactgaagaaacctcaaaaagtcaaggaagtggccttttcttctttatggcggccggtaaatgagatatggccggcaagagcgatgggtgtctctgtttcaatggatggtcagacttttattccggtgggcactaaacggctgacttatgattttagcttgacggaaggcacccgttttccggcatctctttcatttgccgaaacggaagctacatttgtccgcttggaattattgagtggtggcttgtgcccgaaaggatattttcatgaagggttgcagagtgagttggcaatagatgaaatagaaatatattaatctcaagaaattatgaagaaaatagttgttcttttagttgtactgttgggctgtatgccggtaacggcttttgcgcagaagcaattcttttttaaggatggcaggtttgtagtagcacagtttacagatttgcactggatgccgggttctgcaaagtgtgccgaaacggcagctactatccgtgctgtcctggcagccgaacatccggacattgctatactgagtggggatgtggtgaccgatgaccctgctatggatggatggaaaagtgtagtggatattttcaatgaagccaagatgccttttgtggtgatgatgggaaaccatgatgcagaatacttaacgcgcaatgaaatctatgatttcctcttgaagtctccctactatgtgggggcaaaaggccctgaagatattatgggatgtggtaattgtgtgatttctatttatagtccggagaagaaggaccaggtagaggcattgctctattgcatggattccaacgactatcagcctaataaaatctatggtgcttacgactggattcatttcgaccaaatagaatggtacagaaagcaaagtaaacactttgcagagaagaacggtggtaatcccgttcctgctttggcctttttccatattccgctgattgaatacaacgaaatcagaggtgacgggaaaacttatggcaatgacaaagaaggtggagttgcctctgctaatatcaattccggtatgtttgcttccttccttgacatgagggatgtaatgggagtatttgtaggacatgaccatgataacgattttataggaatagataaaggtattgcattgggatacggacgggtgaccggtgcggatgcgtatggagagttgacgagaggagcccgtatcattgaactgtacgaagaccaattcaaatttgacacatggatttccactccttcgggaagggaggctgcctactattacccttcaggtctgaattcggatgaggagcagagtatggcttatttgccggctacgggaacttctcccaagaagcagggcgtggcatatacctattatgaaggcaaatgtaaacgtgttgccgatattgccgcctgcaataaagtgaaggaaggcgtgatgaagaacttctcgattgaagaagtagccgtccctgatcattttgcttatgatttccgtacgttggtgaaaattccagaaaggggagtataccgtttctatactttttccgatgatggttctaaactatacatagacggtaaattgattgttgataacgacggtggacacagcggacgccgtgccgaagggaaagtcgctctcgaagcagggtaccacgagttgcatctgctgtatttcgaagattacatgggccaggaattggaagtcgggtattcgggacggaatgttctggaaaccgtgttacctgataccatgttgtttgtaccggattaaatcagcgctggtaactctttgtctggtactctttccgatattcattgggagagactttcttcaaagctttgaattggcgggacaagttcttcagattgtttattccgacttgttccgccacatctgcaatcggagcatcactggccaacagcaattgggcaaagcgttccatcctaaggttgaagatgtatttgtggatggattgctgggtgacttgcttgaagcgaatctccaataaacggcgtgataatggtacttgtttcactatatccgatacagtgatatcagctgctatattctgatggatatatttcagagcggtttggatatgggcatcggtggtagaatagaagtcggtcgaaagccggttgattatattaactggttggagcactacgtcctgataagtggcctcctcatcattcaatagatgttctatgagggcagctgcctcaaatccgcctcttacaatgttttggctgatactggataggggagggtctgaaagattgcatataatctcatcattgtcgactcctaatattgctatcttgtcgggcactctgatgttgttgactttacagatttccgtaatgcggttaccttgattgtcatcgcaagccatgagtgccgtaggttgtggcaatgactttaaccagttgagcaggggcggtgcttcataaaaccataagtcatcaagggattggtcctgataagaatagaaattgtttccaaacccttgggctgctatacattcatagaaaccctcgcaacgttcttgtgaccataccgtatcgcgataaccatagaatgcgaagttctgaaagcctttactcagaaaaaactctgctgccattctgccggtcttgcggtaatcgccggtgatgtttggaatattgctgaaccttgatttataatcctgggccaatgcgataattccgttttcacggaatagctccacattgtcatcattgtcaaatctgccgatgattgcatctgcctgccatgtctttgcccatttcaagactccttctataccatgactgtttttgtaggagggtggcatacggcatactacccatggctcatggcttttggaataggccaataccccctttagcagattgtacgaaaaggactctgtaaaatcggtcaataatatcaatcgaatcatagcagttgactaaatgtaactgattgttacttatacaaatgttagcttaattgacaaatataggattttatttctttttcttcaaatcttttccctcatatttgcagattgcttcaatccatttttcttccagtggcttggactcgtgtttggcgaggtcgaaggctaccatgacggaggtacatacgcattttacttcttgggtttccgtatcaatgacccgttgggcgaggtggaagcttttggttcctatctcagtgacggcagtttgcacagcgatatggtccgaaccataaatctgtgcgaggaagtttgcttcaatatggacgacaacgataccatccttttcccaatctacatccgggcatacggaagcgaaatattccgtttttcctaaatcataaaaagagaagtaaacagtgttgtttacatggccgaatttgtcgacgtcattgaagcgtagttgtatgggcagggtgtggttaaattgaatttcttccattgttttctcttaaactttgtttataatcgctgcaaaaatactatttttgcgtgttaatccgtgaacttatatatcaagaaatgatagaagacatcaaaaaagcctgccagataatgagcgagggcggggtaattctgtatccgacagatacgatttggggtataggttgtgacgctaccaatgaagaagcggtgcgccgtgtatatgaaatcaagcaacgctctgacagtaaggcgatgctggtattggtagattctccggtaaaggtggatttctatgtgcaggatgttccggaggttgcctgggatttgatagaactggctgacaagccccttaccataatttattccggagcgcgtaatctggctcctaacttgcttgccgaagatggtagtgtaggtatccgtgtcaccagtgaggcattttcaaaacggctttgtcagcagttccgcaaggcgatagtctctacttctgccaatgtcagcgggcaaccgtctcccggtaacttcagtgaaataagtgaagacatcaagtctgcggtggattatatagtaggataccgccaggaggaaacgggacgcccgaaaccgtccagtatcatcaagttgggcaagggcggagtcattaagattattcgcgaataaaaggaaaaatggcagaggacaagaggggtttgttgcagcgcttcatcatatggcgcgaaaagaatatcaaggaaaagcagttcatactgattctcagttttcttgtaggtatctttacggcattcgccgcactgatactgaaagtcatcatacactggatacagaacttcctgacggataatttcaatgcgacggaagccaactacctttatctggtctatccggtagtgggtatcttcctgaccggattgtttgtccgctacgtggtgaaggacgacatcagtcatggtgttaccaaaatcctatacgccatctcgcggcggcagggacgcatcaaacggcataacacttggtcgtccatcatagccagttccattaccatcggtttcggtggttcggtcggggcagaggcgcctattgtgctgacgggttcggctatcggttccaatctgggaaccatcttcaagatggagcatcgtacgctgatgctgttggtgggatgtggtgctgctggtgcggttgcaggcattttcaaggcaccgattgccggtctggtatttacgctggaggtactgatgatagatttgacaatgtcttccttgttgccgttgctgatatctgcggtgacggctgcaactgtttcctatatcgtgacgggtacggacgccatgttcaaattccatctggaccaagctttcgaattggagcgtattccgtatgtcattatgttgggcatcttctgcggattggtttccctttatttcacccgggccatgaactctgtggaaggcgtgttcggaaggttgagaactccctataagaaactgataatgggcggtgccatgctgagtatcctgatattccttttcccaccgttgtatggcgaaggttacgatacgatagaattgttgctgaatgggatgagcaatgccgaatgggacacggtgatgaataattccttcttctacgggcacggcaatctgttgctgatatacctcatactgattattctgttcaaggtctttgcctcgagtgccacgaatggcgggggcggttgcggcggtatcttcgcaccttcgttgtatctgggttgtattgccggttttgtcttttcacatttcagcaatgaaatagagatgacggcttatctgcccgagaagaactttgccttgatgggaatggcgggggtcatgagtggggtcatgcacgctccgctgaccggcgtgttcctcatagccgagcttacgggaggatacgacctgtttctgccactgatgattgtttctgtcagttcctatcttaccatcatcatgttcgagcctcatagtatctattccatgcgtttggccaagaaaggagaactgttgacgcaccataaggacaaggccatccttaccctgatgaagatggagaatgtggtggaaaaggattttgtgaccgtgcatcccgaaatggatttgggcgaactggtaaaggccatttctgcctcgcatcgcaatgtctttcccgtgacggataaggaaggggtgctgattggcattgtcttgttggacgatatccggaacattatgttccgccaggagttatatcatcgcttcacggtgggaaaactgatgacttcggctccggcacgtctgtatgatacggacagtatggagcgggtgatgcgtacctttgatgatacgaaggcgtggaatctgccggtggtggatgcggaaaacaaatacttgggcttcgtgtccaagtcgaagatattcaactcgtaccgtgaagtattggtacatttctcggaagactgaggactttttggtatttactattttactatttacaagttactatttgccgttcggggtgatggggcattgtaaatcgcaaagaagatgcttcgtacattgtaaatggtaaattgtaaatgggcaaatgagttgcctcgcaaatggtacattgtaaatggtaaattgtaaatgaaatggtggaaaagaagaatttgaggattgtatatatgggtactcccgactttgcggtggaggctcttcgttgtctggtagaaggaggttacaatgtggtgggtgtcattacgatgcccgacaagcctgccggacggggacataagctccaattctctccggtgaaacagtatgcactggaacataatcttccgcttcttcagccggagaagctgaaggatgaggcttttgtggaggcgttgcgtgcatggaaggccgatttgcagatagtcgttgccttccgcatgttgccggaggtggtatggaacatgccgcgattgggcaccttcaacctgcatgcttccctgcttccgcagtatcgcggcgcagcccccatcaactgggcggtgattaatggtgatacggaaacgggcatcaccactttcttcctgaaacatgagattgacaccggtgaggttatccagcaggtacgggtacccattgccgatacggacaacgtgggtatcgtccacgacaaactgatgctgttgggcggtcgcctggtggtagaaaccgtagatgccattcttgccggtacagtgaaaagtattcctcaagaagaaatggccgtcgtgggtgaactgcgtccggcaccgaaaatcttcaaagatacttgtcgtattgactggaaccgcccggtgaagcgtatttacgattttgtacgcggcctttctccctatcctgccgcttggacggagctggtccaacccggtggagaatctgttgtggtaaaaatcttcgagacggagaaaataggggaatcccatcaactggttcccggaaccttgcagacagacgggaagacctatatccgcgttgctgccgaagatggctttgtcggcatctgctccctccagcttccgggcaagaagaaactgaaaacggatgaactgttgcgcggcttccggttgacggaaggatacgtgatgaaataactgattgtcattcagtgacttcctactgcaaacttactgcataccttttgcagcgtcactgcaaaccgctttgcagtgttgctgcaactaatatgcagtgtgactgcaactgctttgcagtgctactgcaacacgtttgcagtgacgctgcaaaaggtatgcagtaagtttgcagtgagagttttgatttccaatgttaggctgaattaaatcttttctctatatttgtacataacaaagttcgtaaactttagaacataacattatgaaaccaatcatatccccttctattctctctgccgattttggttatctggcacgagacattgaaatgattaacgaaagtgaggctgagtgggtacatatcgacatcatggacggtgtgtttgtccccaatatttctttcggattcccggtactgaagtatgtggcaaaactgtcgcagaaacctttggatgtgcatctgatgattgtacagccggagaagtttattccggaggtgaaggctctgggggcacatgtcatgaatgtgcattacgaggcttgtccgcatctgcaccgtgtggtgcagcaaatccgcgaagcagggatgcagccggcggtaacaattaatccggcaactcccgtatccttgttgaaggatattattaatgatgtatacatggtgctgataatgagcgtaaatcctggcttcggcggacaaaagttcatagagcattctcttgataaagtgcgcgagttgcgtgaattgattacggttaccggttcgcaggccttgatagaagtggacggtggcgtaaacttggaaaccggttcgcgtctggtagaagctggagcagatgtactggtggcaggcaatgccgttttctcggctcccgatccgaaggaggccatccgtgcattaaggaatctgtaatccgtcttctggattgataatcgacagctggcaacggcatcctttccttcgactgttgatgccgttggtagttggtattttgtgtggagatgcgtttccacacgtgctttctgcatgggagtatgtggcaggttttctgctttttctttttattataggtagatacaagcataccggatgggtgtatggagcggcggtataccttttcttgggtggtacggggggctgcttgatgagttggcagcagggaaagacggtatttcccttttcgggcaaacctgctgtttatagggtttgtatccgtgagcatccagaagagagggagcgcagcatattgtgcagggttgccctgctgggagaggtagagaaggatacagttacgggttgcccccggaatcatctttttctggcttattttccgaaagattctgctacggccactttgcgccgtggtgatgagttgctggtatctacccggcttgttcctccggcaaacaatggtaatctcgacgagtttgactatgcccgctacctgaggcggaaaggctatagcggcacggcttacgtggctgacggacattggcggaagacggggcatgatgcctctcgcactgtcagccaggtggcactggattatagggcgaaagtggttggcttataccggagtttgggctttgaagctgatgaattggccgtgctttctgcgttgacggtgggggataaagaggaactgagcgatgatattgtggagacctattccgtttcgggagccagccatgtactggcactttcggggttgcacataggttttctgtatgctttgctcttgtttgtgcttcgtcctttgtggaggcgatggcggcggttaaaacctttgttgcttttgcttctggtccttttcttggtgagttttgcttttttcacgggattgtcttcctcggtggtgcggtcggtcgtcatgttctctttgttggcgtttgccggtttgcagccggaaaagccgctgactctgaatacgctggcggcaactgctttcctgatgctgctgtgcaagccggtctggttgtttgatgtcggttttcagttgtcattctcggcggttacagctattgtacttgtacagcctaagttatatgccctttggaaggttgacaatcgtttcctgcgatatttgtggggacttatgacagtgtctgtggcagctcagctgggtacggcccctttggtcattttctatttctcccgtttttccactcattttctgttgactaatctttgggtaattcccatggtgtcactcgttctgtattcggcggtctttctattgatgcttacgccgctgccttttgtacaacatctgtttgcaagggtagtagaggcattggtacatgtccagaatgaagtgcttcgctggatagagcatcttcccggcgctgctgtcgataatatttggttggatatatggggcgttctgctcgtctatctgttcttggggatggcatattatggctttctacgccttacggtacgtagagtctgctttgcgttgctggcattgttggcagtggtttcctggcattccctttccatcatgtccaatgctccccggcaggggattgctttttatagcgtgagaggttgtcccgttgtccattgtatggcagacaaccgtcattcttggttggcatgtgccgatagcttgccggatatgccgcgtttgtgccgtgccctttctccgcattggaaccgcctgcgtctggagactccccgattggttgccggagattataccacttccggcttatccatgcgtaaccagattgtctcttacgccggtaagcgcatctgtcttctttccgacaaccgttggagaaacaagaactcttcccatcccctttcagttgattatctgtatgtctccaaggggtatcaaggtgggatagaggaacttacttcactcttttccatgggcatggtggtgcttgacgcttctctttcagactattatcagaataagattgccaatgattgcgtttgcttaggtattccctatcttcttctttctcaaaaaggttcttaccgcatattgttataaatcacaaacttttcgtacttttgccccttcaatttgttataaacgccaaatagtaaatagtcaatcgtcaaatagtaaataaaaatatgttgaccaaagtaatagaacaatccaagatagaccatttcaccaaatggtttgaccgtgcagacaagatagtaatcgtttcgcatgtgggtcccgacggggacgccatcggctcttctctgggcttgtggcacttcttcagctcacagggaaagacggcgaatgttattgtgccgaacgcctttcccgacttcttgaaatggatgcccgggagcaaggacgtccttctgtacgaccgctacaaggagttcgctgacaagctgattgccgaggcggatgtcatttgttgtctggactttaatgctatccatcgtatagatgccatgggtgacgctgttcttgcatccccggcaagaaaaatactgatagaccatcatctccatccggaggatttctgcaagattatcatttcccatccggagatatcttccacttcggaactggttttccgcctgatttgccgtatgggctatttcagtgacatttcaagggaaggagcggagtgcatctatacgggtatgatgacggataccggcgggttcacctataattccaataaccgggaaatctatttcatcatcagcgaactgttgtcgaaaggtattgacaaggacgagatttaccgcaaggtgttcaatacttattcagaaagccgtttgcgcctaatgggatatgtcttgtcacaaatgaaggtctatccggactatcatgcagccttaatttctctgactaaagccgaacaaagccagttcgactatgtgcgtggagatagtgaggggtttgtgaacattcctttaagcatcaaaggggtgattttctcttgcttcctgcgtgaagatacggagaagccgatgataaagatttctttacgttcggtcggtacattcccctgcaatcagctggctgccgagttctttggcggcggcggtcatttgaatgcttccggcggtgaattttatggaacgatggatgaggcccgcaaggtctttgagcaggctttggagaaatacaaaccgctgctgaatgccaaaggataaaaaaagttcagttgtaaaggttaaaagttacgaactttctatctgcagctttcaactttcaaggaaatcagatatttttgtacgaaattactaaataacagaaatgaagaaacttactttattcttttttgccttacttgcagtttgtttagccttccaggcatgcgataattctaaaacttatgccgaaatgcttgaggaagaaaaagatgccatcaaagcgtttatcaaagacagtagtattgtcgttatttctcaaagtgaattctatgcgcaagattcgacaacggatgtaagcaggaatgagtatgtgcagctggcaagcggggtgtatatgcagattgtggataaaggttcgacgaatcctgcggatacaataaaaccgaatgatttggttttggtgcgttatgaagagctgaacttgcagtctggatatttaatgtctaatctggatataccgataccagattatttggatgaattcaaatatacagttacctcgtcatctattgccggaattttcataaagggttctatgcgtcttgcctatggtacgtctgtgcctgctggctggctggtggctttgaagtacgttcgtgatagggcgcatgtgaaattaatcgttccttctaaaatggggcaacaacaagctatggagagggtttatccttgttactatgatattcataaattccaaatttggaactaacctataaattttaaatcattaacctatgactctaatcaaatctatttctggaatccgcggaactattggcggtggtgctggcgagggattgaatccgctcgacattgtgaagttcacttcagcttatgctaccctgattcgtaagacgtgtactgtaaaaagtaacaaaatcgtggtagggcgtgatgcccgcatctctggcgagatggtcaagaacgtagtagtcggtaccttgatgggtatgggctgggatgtagtggacattgatttggcttctactccgactaccgagctggctgtaaccatggaaggtgccagtggaggtattatcctgactgcctcacacaatcccaagcagtggaatgcgttgaaactgttgaatgaaaagggcgaatttctgaacgctgccgaaggtcaggaagtactccgcattgcagctgccgaagaattcgattatgccgaagtggaccaacttggctcgtaccgtcaggatttaagctacaaccagaaacatatcgacagcgtattggcgcttgaccttgtagacgtggaagctatccgaaaggcaaacttccgtgtagccatcgattgtgtaaactctgtaggtggtattattctgccgcaactacttgaacaacttggtgttcagcacgtagagaagctctattgcgaaccgaccggtaacttccagcataatcccgagcctctggaaaagaacttgggtgacatcatgaacctgatgaaaggagggaaggcagatgttgcatttgttgtagaccctgatgtagaccgcctggcaatgatttgcgaagacggcaagatgtacggtgaagaatatacactggttactgttgccgactacgtattgaaacatactccgggcaatacggtatccaatttgagttcgacccgtgccttgcgcgatgtaactcgcaagtatgggcaagaatattacgcttctgccgtaggtgaagtgaatgtaactaccaaaatgaaggaagtaggtgccgttatcggtggcgaaggaaacggtggggtaatttatccggccagccactatggacgtgatgccttggtaggtattgccttgttcttgagccatctggcacacgaaggtaagaaggtgagcgaactccgtgcatcctatcctgcatacttcatggcaaagaatcgtgtagacttgactcctgaaacagatgtagatgctattcttgccaaggtgaaggagctgtataagaatgaagaaatcaatgatatagacggtgtgaagattgacttccccgacaaatgggttcatctgcgtaagagcaatacggaaccgattatccgtgtctatagtgaggctgccacaccggaggctgccgaggaaatcggccagcagattatgaaggtgattgaagacctggctaaataaggccgaacgaaatgttataatgaatgtcccactttcccgtgaaagagaagtgggactttttttaaaccttcccatgaactcctccatcaaactactactatgaatggcattttagattctataggctcagcaataaccactgtcagtgactttgtctgcgggtatcccttatttatccttctgatagggggaggacttttcttgttcttttattccggagctgtgtccctctgccgcatcggatattcgataaaggccttgcgctataaatcggaagtggcgggcgaaggacaaattagttctttccaggccttgatgagcgccatagcgtcaacagtgggtatggggaatattgcgggggtggctatcgctattacagtaggagggcccggagccattttctggatgtgggtaagtgccgttgtgggtatgtccaccaaattctttgaaggggctcttgccattatgtacaaaggacacgattctgccggagaaccgcaaggggggacgatgtatatcattcttcatgggttgggcgaacgctggaaaccgtttgcttatttctttgcggtggtggggttgataggtacgttgtgtgtaatgcaagccaatcagttggtcgagtctgtcactacggtatttactactccggcaggaatagagaatacactcggtctgcgttttgtgatgggtattgtcattagcctggtggtaggggcagtcattatcggtggcatccggcgcatttcggttatctcggctaaaatagtgccggtgatggttacttgctatatgctgcttgtcttcgttattctttgtttgaattttgataagttgccgggagtgttggcttccattttccagtctgccttcagcctggaagccggtatcggtggaattttgggaactgcactgactggtgcccgccgtgctgcctacgtcaatgaagcaggcgtaggtacggcctctatgatgcatggcgcctcccgtaatgacaatcccattcgtgaggggctggtagccatgattggaccggccatcgactcggggcttgtttgtacattgacggccttccctattcttatagctggaaactatgcgtcggaaggaggcataaaaggcctttatattgctttgaattcttttgagcagctccttcccggctatgggcattatctgttgatggtgatggtctttttctttgccttttctaccatgttctcttattcgtattatggactgaagtgcaccaacttcttgtttggtgcggagaatgccaagtattataactacttctatttggtgatgattgttgtggctgccatgattccgttgggagcagtggttgccatcatggatttggcttttgccttgatggcattgcctacgatgacgtcactgctgttacttgctccacgggtcaggagaaagatgaaggaatattttgcgaactgatagaaagcagcttccactacaagttgatgacctttcctatctctccttcaaaattcggggtgaatacacctttgccgatatttgccttgatttcatcggggctccaaaaacgtcctccgtccagctcgtcactgggatgtatttcaccgtcgtagacagttttgtgtacgaagaccagttccttttcgcgggcagactcgaagacataatgcaagacggtttcgggaacaaagtcggtaatgccgagttcttcgcgtacctcgcgtttcagcgccatctctacactttcacctaaatcgacgtgtccgcctacggaggtgtcccacttccccggttgtatgtctttccattcgggacgtttctgtagatacaactcacctttggaattgaatacatgaagatggattaccggatgaagcagtttgctaccgttatggcattcgccacgggtggcggcacctgtgatgttgccttgttcgtcgacaagggggaacatctcttgattgttatcgtggttcattgtgcttagggtattaataatgatgaatctccatagctcaggaagcggaaatcatgtgccagtgcatagttgtaaatcttcggccaatcaccgtgtacgaaagctgatacgagcagcagcaaggtactttgcggttggtggaaattagtcaccatagccttcacgattttgtattcatatcccggagcgataatgatttgagtgctggtatgcagagcctccatgctatgtctgtccagataggcaacaatggcttgcagggcttctactgcagaggtggcggtggccttggcagacatttcataaggttgccattggtggacgtgcaagtcttcctctgtggcttctggattattcagtaaagtgactccgatgtgataaaggctttccaatgtgcgcactgaagttgttcctacggccactgccttgccgccgtgtactatgagtttttccaatgtgttgcgcgagacagagatgtattccgtatgcatttcgtgcccttctatttcttcacttttcaccggtttgaaggttccggctcccacatggagtgtcagctcttccaattctactcctttattgcgcaatgcgtccaatacgcgtggggtgaaatgcagtcccgctgtaggggcagccaccgaacctttgattttggagtagacagtctggtaagtctccttgtcactttcctgggtctcccggttcaagtagggggggatgggcaattcaccgaagacctcgagaatgtcggcaaaagtcacttccggattattccagcggaagtttatccaatggctggttccgtggcattcaccccgttcggcggtcagggtgagtgacttgcctttcacggtcatctcacgtctcagcatgccttccttccattttttcaggttgccgaccatgcagagccaggcggcatgctcggtttgctggaagttgagggcgtagtcgttcggctgtatgggttccaggcagaatacttcaatcagtgctcccgtttctttccggaaatgcaggcgtgcttggatgactttggtattgttgaatatcatcaggcttcccgatggcagatactccggcagtgaagtgaatctgtcttctgaaacttctccgtggcgatacaataacagtttggactggtcacgtacggacaatgggaactttgcaatgcgttcgtccggcaacgggtagttgaattcgctgattctgatatgtctggggtcttctttcatgatggctttctctttattatatcggctgcaaaggtacggatatttgggaagatttgaagaataagggaaataattcctaactttgcaggaagaaagtaggaaaagacaaactaaaagataagttactatgaagataggagataaagttcgtttcctcagcgaagttgggggcggtgttgtgacaggatttcaagggaaaaacatcgtgttggtggaagatgccgacggttttgacataccgatgcccataaacgaatgtgtggtgatagagaccgatgattataatatccccactccggcagccaaagcggctgccaagaagaagcgggaagaagagcaacaattgcgcacggccgctactgcggcaaggccgtctgctatggagtctcaggtttcagagtctcaatcggtccgtttggagaaaccgcagatatctgtttatcgtcagcccgagatgaaaggtggagatatcctgaatgtttttctggcttttgttccggaggatatcaaggctgtcagcactacacctttcgaggcatatttggtgaacgacagtaattattatatgtattacacctattcgagtgccgaaggaaagtcctggacagcccgttcgcatggtttgatagagccgaatacgaaacttctgctggaggagttcgaaaagtccgagttgaacgaccgtgaacgtgtgatggtacagctggtggcattcaaagataaccgtgcgttcacaatgaaaccggctgtcagtgtggaagtccgcatagatatggtaaagttctataaactgcatacattccagcagacggttttctttgaaacaccggccttggtgtatgatattgtccggaatgaccagcctgccaagcaggtgtatgtttcggcagaggaactgaaggaggctttgatacagaaaaaaacggcagatactccgtccaaaccgcagacggtcatcaagcgtggtggcaagaatgggattgtcgaaattgacctgcatattggcgagttgctggatgacacctgcggcatgagcaacagcgaaatattgaattaccagctggataagtttcgtgaagtgatggaacaatacaagaaaaagcgcgaacaacgcatcgtctttattcacggcaagggagatggagtgctgcgtaaagccttgctggacgagctgaaacgtaaatatcctgactgccgccatcaggatgcttcgttccaggagtacggatttggggcgacgatggtgacgattaaataaaatcaagtatttgaatagtgaatagggcagttcaaacattggaatgccctattcattatttatagtctgacattgactcttgtatttttccttatgtgtatttcttgagtggaaggattggactgcatcatttctgattctatttgctggattgctcttttggctttgtgtacaaacctgcctttgggatattttcgcaaatattcttcgtaatctgctaccgactggcaactatagaagaggcgttcttcattttctcttctgacttctcttatatcagtaatgggaagaactggctgtgaagaaggttgtggatgtgggtggacaatctgttttttaggttcctcttggaactgttcaagttttgcagtatccgtttttaccgagtccataacgatgttttcttctctatttattggggagattggatttaccttgtttcccaaaaattgttttataaagtttgcatgagatgaggaggggtattcttttagaaaatctctgtagtcttcttctgtacggcatgcagcgtacttgcgctcttcttcaaggtgtctaaagtatatggaacctcctttgacaagcaatagaatcaatactataccaaggccggtccatcctgctatgcgtttatgcatgttcgaaggacagaacttttctttaaggcgtggtgatgttgttttaggaaaaagtggagcaataggcttcagctgtactgaaggagagtctgtctttgtttgttttagtatggagcaagcaaactcataggcttgttgggctgtggggcggtcccaagtgttgagggcaaggcatgcgtgaacaaactgggacaattgggaagaatatttctcatctaatgctggaatatgtgcaccattcagttggacacaacctcccataccttcccataatacaagaccagtggataattcataaacactcatccctaaagaccatatatcgctggtagccacaatcagtggtttctctgcaaaacgttctggtcccatataggcaagtgttccggaactttctactttgttgatacttttacgaaaagtatgctccagtttacggctgatgccaaaatctgagatgatgaatttgtcatcatcccctatcaaaatattatcgggttttatatcttgatgaatgataggaggattctgattatgaagaaacatcaatccgcatgatacatcgcgtatgaagcgccagatttgcttttcagacattttgcctttcaagctcgctgaggaccctttgggacagtaaggcattaccaaaaaagggcactgtccaaaaacatcaaaatgattaaggtgcagtagattgggatggtgtaatttgtaggcaagtttgaattcttcccggaaatcttttatgccgttgtcatccaacagtccgtacaactttatggcaacgtctacatctgccaatatatttcgggcaagccagacttcaccaaagcttccgactcctaatagtttcttcagctgatagtgttcagcaaatatatcaccatttttcagttgcatagtttcacaatagtaatcaatctgttagggtagtgttagtagtgtctgtctctgtaaccagaaccgtatctgcctgatatagtatcgttttccattttgcatattgctgtggatttctatataaatagaagcctgccgctaaagccagtaccaggagtaacagaagaattttccggattttgtggtggttgggtttgctgaacactgtattgttcaactttgctttgggctcggtatcctgtagcatgatgtggcatagcacaatcgtaatattgtcatatccacctgcttcaagagcagcttctatcaacctatccttgcatgtcattaaatcatcctggttctcttctataatttgcattatctcttcgtcgtggcataaaccacataacccatcactacatagtaggagagtatcgccatcctttaaattataggaacggaaatcgggattggaacgattggtcgggtctcccaaacagcgggtaatgatattactgtaaggatggtcaaacgcattttcaggatctagttttccctgatctactaaatcttgtacataggaatggtctttagataaacggcaaaaacctgaattgccattgaatacataacaacgactgtcgccacaccaacagatataggctttatcgttcaatatccaagcaatgacaatagtagtacccattccctgggtactactatcttctttacttgcattgacaatatttaaatcagcggttttgacagttctacccagaaattcttcaacggcttcttctgaggtaacaatgccttcctgcgtaataatatctcctaaattctcgggggtgaatgcattttgcaccgtctcaatggctatggcagaagcaacttctccggcattggtgccgcccattccgtcggccactaccaatatgctgccataccgtcctaaagaaatgggttctatcgattgggggataatccactctgattggcataaatcacgattgacaacaaaattgtcttcgttgtttttcctgactaaaccaacattggtacctgccgctaatttaatgcttatctcggacatgtttaattttaatgtattaaatttctgattggtactaaacgatccttaccctctatgcttcctaccatgaaacccactactttgtaagaaccattttctagaaggaatgctggagaaccataataaccgggctctgccacacgattctgtaatatggtagtctcgtattttgtatcggctatattggtatggtcattgaaatgagccggagtaagattatgaatatcagcataacctgcatagcccaccatttgaacttctgtacctccactcatgttgtctgcggcggtaatgtcgtaaggcaatccctcaccataaacgccttttcctctaatgtatgcccaactgttggcagcaggggtaacaatgctgacactgatatatttcctacgtgtataggtcaattttatcccatgttcccttagttgtaccctgatggatttatctacttctatttcggtcacttgtacatcatttcgtccgtctttggcaaaatcgctactggtaaatgtcagaggctttccagttcctttggtactgtatgcacggtaatggataatgatattacatcctgctcctttgtatacagccaatagtttacgccatgggtctttccactctgtgttggagtatatccatggctcgacattctgcctgtctgttacaaacattccgtttgatagcatgaagccagttccgcagattatatctgaaacttgtatgcccggatcaaactttgttccattatattcgatttcaatacggtcgactttaattgtatagatataatcataataatctttcaaatctcctgaagcattactgtcttgttcatctgctatatcagggtcttcataatattggtctttggagagtctggtgccttcttgtatatttgcgttaatggcattgcttgaattctcaatgcttttagtgcttatgctgtttgagagattgtccaagtctgatttgaccttatagaaacttgcattgacattctttaattgactattaacgttgtccaactgtgtttttaaggcctctgcattaccgtcactgtttcgtaatttggtctctaactcccgttgctgtgcttctagagatgctctttcggtccccagtgaatccaattggttttggtatcctttcagttgaagttcttgttcttctgtcttctgtgccaacaaatcattttttacacctaaactgtagttccaggcagccaatcctgccaccgccagtacgaaaacaattcccatgattgttaatgcggtcttgtaggggcgtaaggcttgtttgcggaaaaggctcattctctcagtcaatccaatgctggaagttaatgcttggcgaccttgtggaacaatgaatcccaagcgtggtccgccaacggataattgtatttcatctcctgtttgtaaatagtaggacccatttataggatgtccgttgaccaatgtcggattggagtgtgaaaggtggataagtttccagttttcaccgtcgcgtacaattgcagcatgtttgcggctaactgtttcgaaactttcatcaaagcgtacttggcaggaagcgtctctacctaattctacttggtcgacaatgattttttgggattctcccgcttgatgatactttgaagaggtcttgtgctccaaaataaagtaagttctaccggaagcacccattaatgcccccataccagcccctactgagccggctaaggtacgtttgtaattttgtgtatccatactacttgatatataattaatagttttcaaatctcatttttacatccccaatggagatgatatctccaattttcagtatatgcccttgtttggtgacttgggtggaattgacataagtcccattactggactcctgccacaactttaactccttctgccattgcccgtcccgaataatccatttatcagtggcgggatttgtttctattgtgcaatgatggcgtgatatataggcactttgctgttctgttatatgtagcagattgtcgcgttctctcccgatagtaaggattctattgccatattttataagttcacttaattgatatatttttccgtactcttcaccttgcataatacgtatacagaaaccattgactgtttgtggtggacaatatcctctttccatagggacttggcttattgctggcaggtgttccaatacctcttgcacagactggaaacgttttttgaaatctggattaagacatcctgcaaagagttgctgccactgctctctatgtttcaactgtgtcaatttctgctggttccaatctccatttttcccacgtttctggtatagtgccaattcattatgactgctcaattcgccaaagggcaaactgccagttaataattgaaaggctaatactccaaaagaaaaaatgtccgtagtgggtaggacagtggcctcacctcgcatgcggttcacttgttctggcggcatatatgcataagtcccgaagatttggttgggtttaccaaaaatattgcgttcagtcatacgtttgtttctatcccctgctataccgaaatctgtcaacgcagcaattccgttactcttgaaaaggacattctccggctttaggtcacggtgaaccttgcctctggtatgcaaagcatgtaaacctattagaatttgttggcaaattagaggaatcttactgcttccagaacctaaataaggtgttaaatctcctccggaacagtattccattacaatataagggttgcctccaactgtaccgtagtccaatgaacgcactaaatagtcacaatcaatttgcccagttttgaattccatctcgaaacgttccattaatggtttacgtatttcaggaggaacttcccataatctcagtagtttaagcgcataatctttgcttgcgctgtccgtaacccgatatactttaccgaatgaaccttcgcctaatgtttgggaaaccctataacggttattgatatattcccctacattataatcacatctgtcgacagtccggttattcacaagagttatatttagtcacattcaaacttgaatcttcggtcgcctagtacaatgatatcatccggtatgatttctatttttctgtttacctggatataggtcgtttggagcatacttcggtcaagcagataccaatgaccatcatcgaaaactatttcagcttgttcctttgaggtgattgtacgattagacatttctgtattttcccggttcaagatgatggagttcccttcatattcaaatcttttcggaagaatgttctcttcttcttccggtataattgttaatgaacagtgaggtttggtttccggttctgtctctgtgatgttctttatttgtcggcgtatggttggccgatgtacgcggacaccgcagttcgggcaaaaagagcaggttattgctatcttacttccacattcatgacagagcattttctcttcagaaacggaagatgcttcctcttctactcttattgttttgtattcattgtttgttgatatgtttgccttttttaatggagttccgcagcaagggcaacttgtgaaatctcctactaccgggtaattgcaattgggacattctataattggctgtacaacagtagaatgattctcttcttcatttgttgtggaaaacactacagtttttctgcatttttcttcattagagctgacattcaatactgttggtttgggtatagcttctccatgaccttcttttgaaataaaaatgtcctgactgttggcataattctccggcattcgcaaaggttgcccgcatttcaggcatactgttgtgttggaatggttgtcccaaccgcaattcatacatctcataagattttactttaataatggaattactttgtataaatcagagtttctcaccattgtcggtttaccatgaatttagaatagacctccctttttctgggaaagaataattgaagatatttttcctcctttgcttttaactatgagagttccttctctggccttcttggtttttcccacttttagaatgagtttgccacggtcttttgctatagcttcacaccattcaggaatatctgcaacttcccattcggcattggagtctacttgcagttctttaatttctcctttggagccgaattccaatttatctaatgcgatattaatgaattcttcttggccaccttgggtaacactgaccgtagctttcatcttttcattactgattgtaatggtggctttacgttcgatagtcagccaattggtctggcagcttatggagagtttcttctcaccgggagtcacttgacaccagtctgcatctgatattgcagtccattgttctggaagactttctatttttatactttctgcagtctttgtctcacacccaaattccaggctttttctgtctatggtaagtctggtgatttcggcaggaggcgctggcttgggagcgggatttattttttcctcacactctttgattttatttttgcatgcttgctccagattgctgtcgcatttcatggctgctttaaaacttttaatagcgtctctgtatcttcctcttttcatgtatgtctctcccttttgatagatggaggcgcattgcccccatatacttattggcatagagagagcgaacgctaaaacaatcagtctgataagtttattcattttcattgttgtctatgtttatatatggttctattttttttgcacggtcttcaaaagcctgggctgctacggcttggtcaaggtctttcatgatatttgccttttctttaaaaacatgataggcagaatccagtatggcctctacttgctgtttcagttctgttgcatttaagtatattttcgcggagatggaatctttgtagtaatttatttggcggtatttgccaatggcatttatgtaaaaatcctcaaatacggaatcattgttttgctttaaagtgtcaatgtcaaatcggaaaacatctccttgtattttagagttttcgccttcttgaatgattgacagacacattttgtcgtaatcaatcgttggagtcggttccggtatggattccactactggttctttgccgcttattagcgaaaagatgatgacaattgttgcgaatatagctgtgattgctgctacgactataacttttttgcgtttccctttgtcttgatagggtgacatcttatttatgtcagaagagtgtgcgctaatggaatcctcatgggttttgtcctcttcctcttgcaaagtatcatggctgttgtttgacagactaaaggggacgggacttccattgatatgttgggaagtgtagtctgcaatttgtctggctgtgggtctgtcccatggatttaaggcaaggcacttgtaaatgatatcctttaattcttgagaaaagtcttcgttgataagtggaatgtctgcaccgtttttttgcaatacgcctccatgatcgccatagggcggcataccggttagaagctcatacattgttgctcccaatgaccaaatgtcactagccataataggggcgggagatggaccaaaacgttctggtcccatataggccaaagttcctccactggattcttggccttggttcctgcgtaatgtacttctaatccgtgcgctgattccgaaatccgtaatcatatacttattctcatcattaatcagaatattatcgggttttatatcctgatggataaccgggggagtttttgcatgaagataagccagtccctctgcaacatcatggagcaaatgccagctttccgtttctgttatccggttgttgtcagtaaggtattggaaggccgaaccgtttttgcaaaaaggcaaaatcaggtatggcatccgttcccagcagtcataataagtaggatgcagtaaattggtatgattcatatcaaatacgagggagaactcttgtgtgaaaagggatatccccgcatcgtcaagccccatccctggagcatatatttttatggcgaccttaacatccgtaagtttgtcttgtgccagccaaacttcagaaaatcctcctcttcctagttgtttgagtagctcgtatctatctgctatgatttgtccactgtctaacatagaacttataaattatgtaaaagaactgttttcttttggaaacagcctttctttgtgtgattgtattattttgtttgattgagtatattcgcaattctttatccacaaagtaattaataaaaatgtaaataagaaaatgagaaaaagtttgaaatgtactaaaatgttgttttaatggcttatgtagctaaatattgtactatgatgtgattttttgtttcgttttaataaagcggtagcgtatgctcttttgtggttgagaaatacgccttatgcttgacggtatttcgcaaaaatattttaagtttgtagatgtattgaataaataatctaattacgagaaacatgggagagaggatggataagcgaattcgattttatatttattggatattagggtttgtgcttctaggagcttgtgcgcccggagataaagaggacgtatacacagaaatgagagcttttgaggatttttcccatataaatggagattctgtggccattgtgccccgaaaggtaaggttgaaggcttttcaaaagatggaagaggcaaaggatagcttggtcaagtataattatctggcaatgacactgaaaacatatttgattacttcacagcttgattcggcacaaatcgtaatccagcagatacatgactttatagaaaggcagcatagttcttctcaaatggcagatttggagtctgaatgtttcaatatgaagggaaatatctttgcacgtgttgggaatatggattctgctgaaatttgtttccggaaggcttatgaattacggatgagagggactaggattgaagtggtgccggatattttgatgaatcttgcagatgcgaataaccgtttaggaaaattggatataggggcagcttggtataggagagctttgttgatgtgcgactctttgcatatagcttctaccaagaaacctcccatttattatggtttggcacaagtatatgttaccatgcgtgattttgaacagtgtgattactattataatctagcaggagaaagctatgacagtatgctaccttatgaaaaatatatttatttgaataatagagggacttcttactattatagggaggattaccagacagcgataaaatatttccaaaaggttattgatttagtcgaaggatatgctgatatgagttttgaacttaatctggggaggttgaatttaggagactgttatcttcaactgaataaggttgatttggctgttaaatatataaatgaatgccaacttttttttgagggaatgggggtgagtactgcactatattatatcgatacgcagaaaatagaattggctctgcttcagaaagactttcaagaggcacgtcgtttattgtccgagagtgtagtccctccgggcatcgaccctgatatggtacatatccgtaataaataccttcagcagttttacgaggaaaccggcaactacaagagggcttatcactatctgcagaggaacaaccagcttgatgattctatcaggaatgagcgtgtccggatgcgtacggcagacttgactttgcgttatcagcaggattctaccttgatagcacatcgggttttgcttcaggagcagaaaaacaaggtgctggtgctgaggcagacacagtttgtcgtgtttgctgtagctgttgtatctatattgacggcggttttcctttatctgtacagcaaaaagaaacgtgctttgttgcttgcacggaatcatcgcacagtctctacacttcgtctggagaatatccgtaaccgcttgtcccctcattttatcttcaatgtgctgaaccgggagatggtggagcggaatgtggaagaaaagcaagagctttcgtcgctggtaaaactgatgcgtcgcaatctggaattggtggaacaactgtgtgtaaccttggcagaggagctggattttgtgaaaacatatattaatctggaacgccgttctttaggtccggattttcattcggaactgaagatagaaaaggatgtgcagccggagcaaataaggattctgtctatgatgattcaaattccggttgaaaatgcagtgaagcatgcgttgcgcgagaaggaaggtgaacgtaatctttgggtttcggtctgccgccggggaaatggtatctgtataaagataacggataatggtggcggttatcgtccggacagtcggaaccggggcacggggacgggaatgaaagtcattatgcagaccattcggattctcaacaataagaacaaggaggccattgatgttttggtgcacaatgtctctctacagagtggtgagatgggctgtgaggtgactttctggctgcctgacaactacgattacagaatttaaaagaaccgtttaatcttattttttgcaaggataggcatatttacagacaaatagtccgtaaatgaccttctattgctttgtatgggagtaggattatgtatatattcgcgagaagaaaaacataaaaggaacatggataaatataaggttgcaatagttgacgacgatgaggtggctcttgagaatctgagttttgaattgggaaaggatgcacgcttctttttgaaaggaactgcccgtaatggtaaacaagggaaaaaactcattgccaaggtacagccggatttgttgttcttggatgtggaactgccggacatgactggaatggaattactgcaggaaatacgtgacagtgtttcgtggaatatgcggattgttttctatacggcttatgataagtacatgattcaggctatccgggaggctgcgttcgactatctgctgaaaccttttgaagagcaggagttgcgggatattcttgcgcgttttgtagagcaggcagaggctgggcagagaatgtcatatcccattggtgcaccgttgcataccggacagacatttatcgtatttacgccaactaatgatatgcgtgcgttgcgtccggctgaaatcggcttttttcgctattgttccgagcgtaaacaatgggaggtgatactaaacaaccagccgccgttggtgttgcgtcgcggaatgactgctgagcagattactcaatattcatccagtttcgtgcagatacatcaatcgtatattatcaatattgattatctgatgattataaaggatagcaaatgcatgctttatccaccatttgacaaagtgacggaactgctggtttccagaaagtataagaaagagctgcaagacagattctgcttgtaaagtgataagaattatttggttagggagttgacgccgcaggttttggtggcgttgacgtaaagaaaaggcattgaacctctaaagtccaatgcctttttatttatcaaatactattttcgtatttatcagaagcgaagtttatttcacttcgatacctttgttctgcagtgtgacgttcaatactctggcataatcagcatactgcttttcattcagagtctttttcatcaacttcagattaccataaactgcattacggagtaacttctcctgattcttcttggaatttgtagcgcgttccatctgttctgtaaaatattcgcagatgtttgccacttcttcatgctggttggaatccagattcaaatacttgctcaactttgttatgttgatgttaccttcccattttgcagttgtaggttggtttcctgctgcaaatgttgtagcagtcaggcagactgctgccactaatgttaatcctaaacgtttcataatacctactttttaattgttattcctaaaaactaatctcaatctaatacctattgaaaactctctaagcgcttagctttttctttttacctatgcaaatataggtatatgttttataacacaaaaatgaatacgtaaaaaagtgtagtttatatcttcatttcttgacttaaatcaattttgtagtgtgaaaatgctttatttggatgctttttgtaatacgaatgtaatgtaggttaaatgaaattcagtttattgtaatggataaaaggatttttattagtcaaaatgttattgccaaacagtttcgggcaattctatgattactctgctttcagagcagactcccacaaagcctaatccacctatgacgttgcaaggcagactgataggttccattaaagtattgtcgtaatccccatcatccaggcagtttaaggctttcaggtagcggtattcggcttcagtgatactaagcagccgtacggtgatggtttgtttgcgggatatatggtcgtagtagtgtccctctaccggataatattcttggtagagaggggtatatacttttaatgtggcatacgaatcacggaaagtgttatcattgaatatgttgtatttgttatttatggtgggaaacaattcattttcttcatcatcatagttgccagggtggccgtcagtcagtataacatcttcccggttgatgatttcgttctgtcggggagcaaggatggtagtgtctctgggtatggaggcccaatgccaagagccgtcctcgtcttccactttgatgaggctgccgttttcatcttccaggtattctttccatttgcaatagtaactacggtcattccaaatgtccagccggtagtagttcttctcgttggggcggtcttgcaatgtaattttgtattggcggtaaagggtttgtccgctgtactcgcgcaggtaggccaagcaagtgtccacgtgcaggctctctatcggttgcggcacggtgacttcggcactggcatggtattttccgttttcggcagtggcttctaggcgtatgttgtcgccgggatgcaaaggggtgttgaggcgaaacagcttatacaagatagcatcgtatacaaagatggcgtcttccggataattttccggtggaccgaagatttcctccggtgtcagtgcttgaggagtttcagcaatgcggttattgataaacaaggtcagtgtagcttcgttcaaacgtactatgctgctgcccttgctcaagtgcagaaagacttcattaacgtcttttcctgcatccagttgggcattcatgatgagtagcggttgttggttgtctggattgtaaggaatttcattttcacatgatgccaacaagacaatagctactatatataataggtgtaatttcatttggatcttcatatgctgatgtgtttaaaatctgtaagtataggtaactgaagggatgcagggcaggatggtcagttttttgatactgattttcccttcctctttatgttctatgaatcctccattaccatccggttggtatagataactgcttttcttgtatttgctgtaaacgatgttcggattcatggcattgtatgcattgtagatactgatattccaggtgcgtatgccatgtttggtttttttgttgaagttaacacctaggttcaaacgatggctggcaggcaggcgatagttgttgcgtctggagatgtagccggtctcttcgatgactccatcggggctgacgataatagtagccttttcggggatagtgatacatccaccggtattgaatatccaggaagctcctgcatcaatgcggtcactgaacttatggctgagattgaggctgatgctgtggcggcggtcatatttgtaggggaaccatcggccttggttgatggtaccgttcttaaaacggtgatcggtcttggatagggtatatgccagccagccggtagtcttgcccaatgttttctgtaccatcagttccagaccgaaggagcggccttcgcccatttccactttttcttcccagttggtagaggtgccgaagaaggatacaccgtcttgatattcaagtatgtgtttcatctgtttataatatccctcgacggagaactcccaacccggcagtccggaatagtagcctcctatggagaactggttggcatacatcggactgatgtctttggtaatgggtacccagaggtcggtaggcatagacagcggagtagaggacagcagatgcacatactgtgccatgcacgtataggatgctttggcagaatatccttgtccgaggtcatagcgggcggaaaggcggggctgcagcgaatagtagcttttcccttgtgtgtggaacagcgatgtgcgtacacctgcattcagactgaacctggcgtttacattgaaattgtcttcggcgtaaagggagatttcttgtccgcgcatggcatggctgttgctggtattgtaaaccgtatcttcctggagggcgccattatctatatcttgtattttcgaggtagctattcccggacggaacgtatggtggatgtactctgcaccgaacttgatgtggtgctgcggcatgggggtgtagtcaaagtccatacgcgcactccagtcacggataccggagttgaacttggaggagtaatagtatctgtcttgtactttattggcgacagtataggtatcttccatgtttccgtccagccccatctcatatttgttgtatgagacggtggtgttgcaaaacagcttgctgttgaatacatagttccagcggccgtaggcgatggtgtttccccaattcagatggctgttgtccttggaataattcttaatgctgttgtcgtaattgtcaccgtggtagtaactgtcataatgatagtggtctttccccttgtagaaactgaggaagatgcggctacggtcgctgaacttatggttgacctttgcattgacgtcgtaaaaatagtagttgtatttgtcggaataggtgtcgtctttgtctacaatgagatttttgaagaatagggtggggatggctcgtgcgctgaaactgaaggaggtccgttctttccagatagggccttcgatatgcagtttgtccgtcagcaggcctatgctgaatgcgccgtggtatttatgcatgtccccgtcgttggtccgtacatctactatagacgaaagacgcccgccgtagcgggcaggaaaagaacttttgaagagtgtggtgttctttaccgcttcgggcgtaaagatggagaatactcccagcaggtggtctgcgttgtaaacaggaattccgtccagcataaccaggttttggtcgggacctccccctcgcacatacatgcctgcaaaaccttccataccggcttgcacacccggcatcagctgaatggtcttcagcaggtcggcttctcccaatatggacggggtatgcctgatttgtgtcatcggtatctcatgcgctcccatggctgtgctttctatgccggcctcccgcttgtccgagagcaccacgacctctgccagctggttattgctgtccagcctgacgttgagtaaggtgtctttcgtcagttcgaaccggctatgccggctttcgtagcccaggtaggagaaaaccagttccgtttccccttccggcagggtgagggaatagaaaccgaaaggattggtggcagtacctgtggaacgacgactctcaaggatattggcaccaatcagcgtctcggaagacgctccgtcggtcacgtatccgctgatggtgaacttacggctaacgggtttctgcggcacgggccgcttatggagtagaatgtgctttccggatatttcgaacgtgatgggttcgttttcaaaggcacgttgcaatatctcactgatgttcttttgtttcatctccagtgtgatgcggtgcgtgagctttacttcttccccatagatgaaggagaatccggttgcattttccagttgcttcacgaaactctctaaagttgcgttacggatattcaggtttatacgtgtttccttgttttgtgcctgtgcatggagtgaggcgcttaaaagaaccacacacatcagaagtacggttctgatgcggtggtgcgaacagatagtagagctggtcattgtcagttaagtttagtagtaaggataatagtgttgttttcttttttataggtaaagttgccggcgtccttcagtaggtcgaggatttctgtaagactctccccttcgcggaaggtagctgtcatatgatagttcttcaggctgtctccttcgatacgtatatcggtacggaacgtttcggaaagttgacggacgatttcctgcaagggttgctgatcgaatgtcagtacgctatgaattacttgggtttcctcggtagtatgtatggcttctgtgggaatggcttcccgtggtggtgctacgtataagaactgataggctgcccagctcgttacacagagcaggactacggctgcggcactggctgtacgcatccagaaccgcttcatgctgcggcgctttagcaaacggctttccagcagcctccagctgttctctgccgtaaagcgtcctcgtggggaacgggtagaagcaaccagtttgttcagtaccttgtcgaaattctcgttattcactttcatttttggcaatttattaagagcctatgactccttttctgcatgtaaagacagctccttttcaggaattccctatgcctatatcctgaaataatgttaatctaaagctctttgtccgtgaaagtccgtcctgcctacgtatgacttccttgtttctctgtttcaatcaatagggaaggtgtgctcgagatgtgcatctcatgttgtgcgagatgtgtatctcatgcagctcgagatgtacatctcatacatgcatacgcggcttcttgcaaggaagatgaagcagagttcactccgtcagcaatgcttccttgagtcttgtgagtgctttttgcagttgcgcgtctactgtctttgtgctgatgttcagctcctccgccacttgtgcatagctttgtttctcttcgcgcaggcggatgaatacttcacgacaacgctccggcaggcggtcgagcgccttgacatatcgggcaaacagttcttcgctgataagagtgtcttcgggggaatcggcctggccggaaacttcgggaagctgttcggacgagagtgtagggtgccggttctctttttccaggtaattgagggaggcatttttggtaaggataaagcagtaatcctctatgttgttcacttccggcaacagggcgcgttgttcccaaagcttcatgaagacgtcgagcacaatttcttgcgcccattcttcgtgcttcacgaaatagcaggcaatacggaacaagcggtcgtagcacagattgtagaaactgtgaaaagcccgttccgagtcttcttccttcatttggcgcaagtagcgtctgacttcttgttcggtcatgcagtctcccggttttgctgttaatcaatgaacatcaggtcgcttattatgccgtccgaaacaaagataccttcccgggtcaggcgcaggcggtctgcctgcatctccagtttgtggctttggaggtagggggctgccattttcgtgcaatattggcacaactctgtgccgaaggcttcttccgtatatgtcagggagattccccacatggtacgcagggaagtcataatgtattcattgtaacgggtcactttatccagaatttctgtttcggaggaacggtgtccctcttcaatggactttatgtatccttccagagaagctgtgttccattcccttgtctccgcattgaaggagtgggctgaagggccgcagcccaaatacggaatgcctttccagtaagcagtgttgtggcgtgagtacatgccgggcttgcagaagttggatatttcgtaatgctcataccccgcggctcccagggtgtccatgagcgccgagaagaagcgcacgctactctcttcatccacttcgctgatacgatggctctgcagcatttcgtagatgcgggtgcctttttcgtaagtcagatgataagcggagatatgctccacatcaaggccgacggcttgttgcaggtcgcgttcccaccgttggtctgtttcatccggtagtccatagatgaggtcgatgctgatattccggaagccggcttggcggaggcagtgtatggctgcgatggcttgcgcggcattgtgccggcggttcaacagtttcagggtgggggcgtcgaatgtctgtatccccatgcttatgcggttgaaggggagggtgcgcagcatggacacatattcttccgtcaggtcgtcgggattggcctcgagggtaatttcttcggcatgttctgttccatacacctctttgatagtccggaatatctgttcgaaatcttcgtgagcgagctgtgagggagttcctccgccaaagtagatggtctctatcggttcttccttcagataacccttgcgggttttcagttcagtgcacaaggcacggatgtactgctgcttcaattcgctgcgagtggtggaatagaaatcgcaatagatacagcgtgtcttgcaaaaaggtatatgaatatagatgcctgccatggtatgcttatggatatttgttgcaaaaatagtcttttggcaggagaatatatcggttttcgggacatttaatgtaatatggaagtagtcagtgtcttggtggatattctcagttttgtctgtaatccggaaaaatagaacattttttgagtcgtatggaaattcattattccgaataaactcctttcctttgttatcagaaaaaggaatgggtgtctattaaaataatgagtaatatgtttgaaggacttgacttttggtttgaacagattatagcttattgcattgccctcgtactggtgcagttcatgaagaaacaaatatagcggcaaatactttattcacttccgtcgtagcacggtttaatcttaggctttttcttgtgatttctgagcttttggggtactaatgaccgatatttacccctttttgaaacaatagtgcccccgaaattaccgggaatggggtaattttgcagtattgaaaaacaaacttaaataatatcatgagaaaaagtaactacttatggctgctgctggtggcagttttattgctgcccgctcaggaaatggctgccaagaagaaaaaagagaaggaagtgacagaccgcgaactttgggccggggtgttgtatcaaatggctgctccggtactgagcaatatgagtgaagggaagctccagaaaaatatgcaggtggagcttagtcccacttgggatggacgcgacaaacgggtgacctatatggaatgtttcggccgtctgatggcggggttggcgccctggctctctttgccggacgatgacactgccgaaggcaagcagcgcaggcagctccgcgaatgggcattgaaaagttatgcgcaggcggtagacccggaaagtcaggattacctactttggcggaaagaggggcagccgctggtcgatgccgcttatgttgctgaaagcttcctgcgaggatacgatgctttgtgggtgcctctggatagtttgactaaacggcgttacattgaagagtttacccagttgcgccgtgtggaccctccttataccaactggctgctgttctcgtctacggtagaatgtttcctgcgcaaggctggtgctaagagtgatgcttaccgtattgtctccgctctgcgcaaggtggaagagtggtatgtaggtgacggcttctatagcgacggaccgggatttgcctttgactattacaacagcttcgtactccatcccatgtatgtggagtgtctggaagtctttacgaacagtggaaaaaataagatatggaatgcgccggattgcaatttccagcgtgcccagaagcgcatgcagcgtttcggcatgattctggaacgtttcatctctcccgagggggccttccccgtattcgggcgttccattacctaccgcaccggtaccctccaaccattggctttgttggcatggcgtggatggttgcccaaggaattgtcgaacggacaggtacgtgctgccatgacagctgtcatcaaccgtatgttcggtgacaaccggaacttcaacgagaaaggttttctgacattgggattcaatggttcccagcctcatatctccgactggtatactaacaacggcagcctttacatggcttccctggcattcttgcccctgggcttgcccgccgaccatccgttctggacagatgctccgcaggcatggacctcgaaaaaggcgtggggtggtgaagaattccccaaagaccatgcctattatgagtaagactgattcattttttatagtatttatattaattgtttgggggattggtggatttccggtggcactctgtgcacagggtgctgccggtgtccttcccgaaacgcatctggtggaagtggggaaaggatacagccagacttccgtcaacactgccgtattccgtaataattcgctggtgacgcaaggtgacgagcaatacatcagttactatgatgcggaagggtttctgactcttggaaaacggaacctccatgccggacagtggacactgcaccgcacacagtataaagggaatgtgaaggatgcccataacgtcatcagcatgatgctggacggtgacgggtatattcatgtagccttcgaccatcacggacagcccttgaactactgtcgcagcattgcaccccattcgctggaattgggtgagaaggagcccatgacgggcgtggatgaaggcaatgtaacctatccggagttttatctgctgtccggaggcgacctgctgtttgcataccgttccggttcttccggccggggcaacctggtgatgaaccgctattccttgaaggagaagaaatggagccgtgtgcaggatgtactgattgatggcgagaacaagcgcaatgcttactggcagctatatgtagatgagcttggaaccatccatctgtcgtgggtctggcgcgagacttggcatgtggaaaccaaccatgacctatgctacgcccgttcctttgacaatggcgtaacatggtataaggcaaatggcaagaaatatgatttgcccatccgtctgggtaatgcagagtatgcctgccgcattcctcagaattcggaactgataaaccagaccagcatgagtgccgatgcaggcggcaatccgtacattgcttcctattggcgcgacccggacagcgacgtcccgcaataccggattgtctggcatgacgggcagatgtggtacagccgccaggtctccgggcgtaccactccgttttccttgaaaggtggaggcacgaagatgattccgatggcccgtccgcgcatcgtagtagatggcggggagatattttatgtattcagggatgaagaacgggggagcaaagtctctttggcgcacgctacggatgtggcaaacagtaagtggagcatcagcgatttgaccgacttcactgtcggtgcctgggaaccgtctcatgacacggaattgtggaagagcaggaagcggctgcatctgtttgtgcagcatgccaagcaaggagacggagagcgggttgtggagtttgcaccgcaaccggtatatgtattggaagtgataagataaaagaacagtattagtatatgaaaacgacatgcttatttttattgggtttggctttttgctggggactgtcctcatgcaccgctcagcagccgaaaccggaagaagtgattgagattatcaatcgggtgaacaactattggcaggagacccatccgcaacatgggcgctctttctgggacaatgccgcctatcatacgggaaacatggaggtgttcttcctgaccggtaatccggaatgctatgcctattccgaggcgtgggcagaacataatgaatggaaaggcgcgaagagtgacaacaaggaagagtggaagtacagctatggggagagtgatgattatgtgcttttcggtgattatcagatttgtttccagacttatgcggatttgtataccgtgaagccggattccgggaagatagcccgtgcgcgcgaagtgatggaataccagatgagtacggacaagaacgattattggtggtgggcggacggactttacatggtaatgcccgttatgacaaagatgtacaagctgaccggcaatccgttatatctggagaaactgcatgaatactggacctatgccaacagtatcatgtacgattcggaggaaggcctatactatcgcgacggcaaatatatttatccaaaacacaaaagtgtgaatggtaagaaagacttctgggcacgtggcgacggttgggtgctggctgctttggcaaaggtactgaaagacctgcccgaaacagaccaataccgccaggagtacatagaccgcttccagacgatggccaaatccgtggctgcctgccagcagccggaaggctactggacacgcagtatgctcgaccctgagcatgctcccggtcctgaaaccagcggtacggctttctttacctatggtctgttatgggggatgaacaacggcttgctggacaaggctgcttatcaacccgtagtgatgaaggcgtggaattatctgactactgtagccttgcagcccgatggccgcatagggtatgtacagccgattggcgagaaagccattcccggacaggtggttgatgccaactctactgctaactttggggtaggggcatttctgctggcagcttgtgagatggtgcgttttttgaatgccgactgattggagagattaaataagtgtatatgttacacaacatatacactttctttgtattataatgtatatagtgttaattttacacccgttaaaaggtttaatataaaaagattatgattgtacggatgaaaaacactttccggatgcttttggcggcaatgttattgtcgttgtttgcacttccgggatattcctggcaaaaatcctttcccgaaaaagattatgtagcttatttgttcacttatttcactgggaatagtggcgatgaagaggctgtgcgctatgctgtaagcatggacggttatacctactgggcattgaatgataatgaaccggtaatcgactcgaaagtcatcagctccaccgggggagtccgcgacccgcatatccttcgttgtgaggatggcaagactttctatatggtagtgacagatatggtttcagccaatggatggagttccaaccgtgccatggttttgctgaaatctaccgacttggtcaactggtcccactccgttatcaatatacagaaacgttattcaggtcaggaggatttgaagcgtgtatgggctccgcagactatctacgacccagaggcgggaaagtacatggtgtattggtccatgctgcatggtgatggagccgatgtcatatattatgcttatgccaatgcggagtttacggatttggagggagagcccaagccattgtttctgccgaagaatgggaaatcgtgcatcgatggagacattgtctataaggatggtgttttccaccttttctataagacggaagggcatggaaacggcataaaggtagccaccacccgttccttgacctccggggcatggacggaagaacccgattacaagcaacagactaaggaagccgtagagggtgcgggcactttcaaactgatagggcaggataagtatatcctgatgtacgacgtctatatgaaaggaagctatcagtttacggaaaccactgacttgaagaattttaaggtgatagacagcgaggtgaagatgaacttccatccccgtcatgggaccattatccccattacccgccatgagctgttgcgcattaccgatgaatggggcaagccgacagaactgggcgcattgcccaacaatcccgtattgccgggtttccatgccgacccggaaatcctttattcccatcagacccaaaagtattacatctattctactacggacggacagccgggttggggaggctggtatttcaccgtattctcctccacggatttgaagacctggcaggatgaaggcgtcatgctggacttgaagtcggagcaagtgccctgggcagatggcaatgcttgggcgccttgcattgaagagaaaaaagtggacggtaagtataaatacttcttctattacagtggaaaccccaagaatggcggcggcaagcagattggagtggctacgagcgattctccggccggccctttcaccgatttgggacgccctgtcgttactgcttcacccgtcggtggcgggcaacagattgatgtggatgtgtttacagaccctgtttcgggcaaatcctatctttactggggcaacggctacatggcaggtgccgagctgaacgacgatatggtgtccatcaaggaaaataccgttacggtgatgacaccggcgggaggcaccttgcaggactatgctttccgcgaagcagcctatgtcttttatcgcaacgggctctactatttcatgtggtcggtagacgataccggttcgcccaattaccatgtggcatacggtacatccaagtcgccgctcggtcctatcgaagttgccaagcaacccgttgtgctgattcagaatccggaaaaggaaatttacggtccggcacacaacgctgtattgcagattcccggtacagatgagtggagaatcgtttaccaccgtattaataaatggtacttgaaagatggccccggcgttcatcgtgaagtctgcatagaccggatggagttcaatgaaaacggaaccatcaggccggtggtgcctaccttttgatttaatgatataacataataatttaataccatgaagaatagattgaaattattggtttggttgtttgccctctcaggtccgctggcagcacagagtgtatctgtcaatggtccggatggaaaattgcagcttacggtatcctgcccgtcagccaacggcgaagtgtcttacgccgtcacctacaatggaaagcaaatgctggaatcttctcccttggggatggagacaaatgtgggtgatttctatagaggattgcagttgaaggaacataaagtcacagctcttgatacggtttatgaacaatcccgaatcaaagcttcgcacatccattaccgggcaaacgaattgctttgttcattcgtcaacggtgaggggaagaatgtgcagataactttccgcgtcagcaacaatgacgtggctttccgttataccctgccgagggagcagggaaaaggaagcgtcacggtgaacagcgaacggaccggcttccgcttcccgtcgcagaccaccactttcctttgtccgcagagcgacgccatgatagggtggaagcgtaccaaacccagttacgaagaagaatataaggcagatgccccgatgaacgaacgttcgggttatggacatggatatacatttccctgcttgttcaaggtgggggatgacggctgggtactgctcagtgaaaccggagtggacagccgttattgtggctcgcgtttgagtgattgggataacggcgtgtatcgcattgctttccccatgccggaagagaacaacggcaacggaacggtgtcacctgccttttccctgccgggctccacgccgtggcgtactgtgacggtgggggaaaccttgaagccgattgtggaaaccaccgtcccctgggatgtagtggaaccacgctataccaccacccatgattacaagccgggccgtggcacatggagctggattctctggcaggacggcagcatcaactacgacgaccaggtgcgctatgttgacttggcagccgccatgggatacgaatatgtattgattgacaactggtgggacaacaacatcggtcgcgaccgcatggaacagtttatcaagtatgcccgtagcaagggtgtggaggtattcttgtggtatagctccagtggttactggaacgatatagagcagagtcccgtcaaccggatggataactccattgcccgcaagcaagagatgcgctggttgcaaagtctgggtgtgaagggtatcaaagtagacttcttcggtggtgacaagcaggagaccctgcgtttgtacgaggagattctgagcgatgccgacgaccacggtctgatggttatcttccacggctgtaccttgcctcgcggctgggaacggatgtatcccaattacgtaggcagcgaggcggtgctggcttccgagaatctggtatttagccagcatttctgtgataacgaggccttcaatgccacgctgcaccctttcatccgcaatgctgtgggatgcatggagtttggcggtgtgttcctgaacaagcgtttgaaccgcagcaacgatggcggaactattcgccgcaccacggacatctttcagctggcaacggcagtgctgttccaaaatcctatccagaacttcgccttggcacctaataacttgacggatgctccgcaaatctgcctcgactttatgaaacaagtgcccactacttgggacgagacccgtttcattgacggctatccggggagatatattgttcttgcccgtcgtcatggcaacacgtggtacatagccgctgtcaatgcaacggcggaaccattgaaactgaagcttgaccttcctgtgctggcaggacaagaggtgtctctgtatagtgatgacaagaagatgcagcctcaattaaagctgcagaggataaaggctgacggctctctgcaactcacggttcagccgcagggaggggcggtaatcgtggaataaagaaggtatggagcaatctttgttttgtaatgatatatcataacggattactccttttgcaaatctttgattatcagaggtctataattgtcctgattcagtcgtatactgaatggcattcactatacgactgaaccctattcactatacgactgaatggcattcagaatacggctgattgtgactatcgaactaaatgtaaatgattaataccgacttaataccatgaatggattcttgaaattattgtccttgtgtctgttcttgacactgaccgttcctttgcaggctataacgaatggagtggcgaatgaacccgattcagtctatctcttttcctactcccatgccgacggcagtggcggtctgaaactagcctggagtcccaatggcaaccgatggttcagcgtggcagagggcagctcctttgtcaactcggacttcggcccctgggggcaaatgaagcggatgctgaaaccgcacttgatgcagacccgtgccgacgaccgttggcactgtatctgggaactgacggaaagcggaaactcccttgcatacgtcgagtctcccgacttgctgcaatggaaagcgcagaaatactttgaccgttctcgccttgccgaataccggccggcggaggtctatcctaacgtgcggaaggaggttctgctgaacggtaccgtacagcagggttggatgcagcgtgtaccgtatgccacggtgcagcgtgtcatctcctttgcagagcataagaagtaccgccaggcactccatgccgaacgtaccgagcaagaccccgtacgttttgccggactgaaaccggtggaggcgactatcgaagtggagacggaatgtgcaaaacccatcagcaagcatctgataggtattttcttcgaagacatcaactatgctgcggatggaggactgtatgccgagctggtacagaaccgcgacttcgagtattcgtctaaggacggttcacaccaaggttgggacggcacatatgcctgggcggtgaaagaggggaatacttcggctgccgttaccattgccgctgccgaccccattcatcccaataaccctcattatgccgtattggaggcgcgtcccggagtgacattgcagaacgacggtttcgacggcatcagcttgaagaaaggggagaagtacgatttctctctcttcgcccgcgtggcaccgggcagcaagggaggtaaggtggttgtttgcctgctcgaccagacgggccgtgagattgcccgctcttccgtcaatgtgtcctccaaagagtggaagaaacagcagacggtgctgacggcgaatgccgacgtgcgtgccgccgtcctctcgctccagccgcagacggtggggacactgcatctcgatatgatttccctttttccgcaaaatacattcaagggccataagaacggcttgcgtgccgacctggcgcagacgcttgccgacctgcatccacgcttcgtccgcttccccggcggctgcgtggctcatggcgacggcattgataatatctatgactggaaaggctctatcggaccgctcgaagcgcgtaagccgttgcgcaatctgtgggggtatcatcagacacgcggactgggctacttcgagtacttccgcttctgcgaagatataggtgccgaacctctgccggtattggcagcgggcgtgccgtgccagaattcgggcacacactcgcactatgccgacaactgtccgcagggggccaacaaggaactgatgcgctacggccagcagggtggcatcccgatggaagagatgcctgcctatatccaggatgtgctcgacctgatagagtatgccaacggcgatgcacgccgcaccgtgtggggcaggaagcgtgctgaggcaggccatcccaagcctttcaatctgaagtatatcggcatcggcaacgaggatatgattaccgaagtgtttgaggagcgctttgccatgatatacaaggctgtcagggagaagcatcccgaaattacggttgtcggcactgtaggtcccttctacgaaggcacggactatgcggagggctggcgccttgccacggaactgggcgtgcccatggtggacgaacactattacgtggatccgggctggatgattcacaaccaggactactacgaccgttatgaccgtaccaagtccaaggtctatctgggcgaatatgccgcccacctgcccggacgtcccaacaacatagagacagcgttggcagaagctctctatctgacttctgtggaacgtaatgccgatgtggtggaaatgacctcatacgctccgttgctggcaaaggaagggcatacgcagtggaatcccgacttgatttatttcaataacacggaggtgaagcctaccgtgggctactatacacagcagatgtacggacagaatgcgggtacgcagtacatcacctcgcacgtcacactgagtaatgggcaagaggctgtccgcaagcgcgtcggcatttcggtggtaaaggatgaggccacgggtgaccatatcgtaaagctggtgaacctgcttccggtagaggtttcctctacagtgaagctgaagggcatcgacttgcagaatccctcggcagtgaagacgctcctgacgggtgacccgaaagacaagcaggcacgttccgtgacttccaccttcgacatcggcggtacggagtttccttataccttgcctgcctattcgtttacggtgatacgtatccatgagaataaggggaaataaggataaatccgtgtaattccgtgcgtgggaacttaaaaacttaaaagatatgaaactattattgactttggcacttgttgcagccatgaccggcagtgtgtcggcacaaaagcaacagactttgcattccggttatcccatcgacccggttcctttcacttcagtgaaggtgacggacagtttctggggacaacgcttgaaggcaagccgcgaggtaaccatcccgttggctttcagtaagtgtgaggaaacgggacgttatgaaaactttgtgaaagctactcatcccagtgatgagtataaggtgggaggcttctcctttgacgatacggatgtctataagacgattgaaggtgcaagttactccttgcagacttacccggacaagaaactggaagaatatatcgacagcgtattggtcatagtggccgccgcccaagaaccggacgggtatctttacaccgcacgtaccatgaaccccaagcatccgcacgattgggcggggccggaacgctggtcggaggtggagaatttgagccacgagttctataatctgggtcacatggtggaaggggctgtggcttattatcaagctacaggcaagcggaacttcctggatatagctatccgttatgccgactgcgtatgcaagaatatcggtgaaggccccggacagaagcgtgtgattcccggacatcagattgccgaaatggcattggtacgcctctataccgtgacaggagataagaaatatctcgaccaggccaagttcttcctcgacgcgcgcggcactacggcacgcaaggacatctatttgcagtcgcacaagcctgtactggagcaggaagaggcagtgggacatgccgtacgtgctggttacatgtattccggtatggctgatgtggctgccattacgggtgacagctcctacatcaaggctatcgacaagatatgggagaatatcgtcggcaagaagatatatattaccggcggtatcggtgcgcgtcatgcgggcgaagctttcggtgataactatgaattgccgaatctgactgcctacaatgagacctgtgccgccatcggcaatgtttacatgaattaccgcctctttctgctgcatggcgattccaagtatttcgacgtgctggaacgtacgctttacaacggattaatctccggcgtttcattggacggaggtaagttcttctatcccaatccgttgtcttgcgatggtaagtatcactttaatgccgaccatacgattacacgtcagccgtggtttggttgtgcctgctgtcccagcaacatcagccggttcattccttctttgccgggatatgtgtatgccgtgaaagacaatcaggtgtacgtcaaccttttcttgtccaaccgtgccgagctgaagttgaatgaaaagaaagtggtgctggagcaggaaaccggatacccctggaacggagatattcgtgtgaaggtggctcagggcaacctgccgtttacgatgaatatccgtattccgggttgggtgcgcggcagtgtacttccgagtgacctttattcgtatgccgacgacctgaagttgggctatcgtgtattggtgaatggcgaggaggtgaccggtgaacttcgtaaaggctatctccggatagaccggaagtggaagaaaggggatgtggtagaggtgcatttcgacatgcaaccccgtgtggtgaaagccaatgaaaaagtggttgccgaccgtggacgggtggccgttgagcgtggtcctatcgtttattgtgccgagtgggccgataatgattttaatatacagaatatcatcctgaaccgtcatccgaaattccaggtgacggagaagcccgaactgctgtatggcatcaacgaaattaccacagaagtgcaggctcttggttttgatgctgccggaaagttggcaaccagagatgtgacgctgaccctgataccttattatgcatgggcacaccggggtgagggcaagatggatgtatggttgccggtaaataggattgatgtagaataggtaagtatgtcgtcataatttagcttatgctatcgttataaacagattaaaaccatgaaaagacttttatttctattgacattgttcgttgttcttggcatgcaggcgcaacagcatgtgatgactgttgatgtatcaaaaccgacggctcggataaatcctgccatgtatggaatcttcttcgaagacattaatttcggtgcggacggtggtttgtatgccgaactggtaaagaaccgctcttttgagttcccgcagccgctggtggggtggataccttttggcgaggtgacggtacaggacgagcggccctgcttcgaccgcaatccgcattatgtgcgcattaccaatgacggctgtcttttgcgtgccggactggataatgaaggttatcgtggcatcggcctgaaaaaaggagaagattaccgtttctccgcctatgtccgtacgccggataccaaaccaatgaagctttccgtcgaactggtgaattccaacggagagaatctcctgaagaaggaactggaagtgaaaggcagtgaatggcagaagctgacggctgtgctgaaagctccttttaccgatgttcgctcgcgtctgcgtgttgtgttgcagacggagggtacggtagatatggaccacatctctctcttcccggtgaacacttggaagaagcgtgagaatggattgcgtgccgacttggtacaagccctctatgacctcaatcccggagtattccgttttcccggcggttgtatcatcgaaggcaacagccttgccacccgttatcaatggaagaattccgtgggtccggtagagaaccgtcctttgaacgaaaatcgctggaactatacattcaagcataaagctttcccggattatttccagagttacggacttggcttttacgaatatttcctgctgagtgaagacctcggtgcagagcctctgccggtactgagctgcgggctgtcctgccaatacgaaagcaacgaagtggttccccttggagaactcggcccgtacgtgcaggatgccctcgacctcatcgagtttgccaacggtgctgcaacctccaagtggggaaaggtgcgtgccgatatgggacatcccgaaccgttcggtctgaaaatgattgccatcggcaatgaacagtggggggaagtctatcccgagcgtctggaagtgttcacgaaagccatccgtgcggaatatcccgatatgcagattgtaggttcttccggtccgagtgcagatggggacaagttcgattacctctggcccgaaatgaaacgcatcggggtggatttggtggacgagcattattatatggctcccgactggttctttgccaatgctgcccgctatgatgactatgaccgtaaaggaccgaaagtctttgccggtgaatatgcatcgcatgaccaccccaccgggaaagccaataatttcttggcggcactgtccgaagcagcttttatgacgggactggaacgtaatgccgatgtggtgcgcctggctacctatgctccgttgtttgcccatgtggatgcctggcagtggaatcccgatttgatttggttcgacaatctccgtatgatgcggactcccaactattacgtacagcagatgtacggtatgaatgccggaacagatgtgctgaacctgcaaatggacggaaaacccgtgacggggcgggacagcctttatgcatcggcagtgctggatgctcctacgggagaagtaattctgaagcttgtcaatgcgggcagcagatcggagaaggtacagatagagttcagcggattgaagaagcggcagcttgtctcgggttcctgcacctatttgcaaagtgatgactggaaagccaagaatacactggagcaggaggctattgttccacgtattcgtccggtggaggtggcttcccgttctctgagcctggagcttcagcctcgttcgttcggagtctatcgtttgcggataagtactcaatcaaaataaattcccatttagtcacctatttaattatgtgaactagttatgaacacttatttaaagaattaaattcagccttttttgaacgattattcttccttttaattataggataggcgtatctttgtgacggcataccggttctgcttgtatgccgttgctaatttttataaactatttaccatgaagaaacatttcattaccggactgcttgcgacttttgccattgccgcaagcgcacagtccttcactgaatggcaaaaccctgaagtgaatgccgtgaaccgtgctccgatgcacaccaactattttgcctatgagtcggcagatgctgcggctcgtggagcaaaagaacattcttccaattacatgactctgaacggtatctggaaattcttctgggtgaagaatgccgatgcccgtcccacggatttctggaaagtggggttcaacgacaagggatggagcgatatggccgttcccggtatgtgggaactgaacggtttcggcgcccctatctacgtgaataccggatatgcctggcgcaatcagttcaagaacaatccaccgcaggtgccaacggagaataacaatgtaggttcctaccgtcgtgagattgtaatacctgccgactggaagagtaaggacatcattgctcatttcggttccgtgacttccaatatgtatttgtgggtaaacggcaagtacgtaggttatagtgaggacagcaaactggaggctgaattcaacctgacaccctacttgaagccgggacaaaagaatctgatagcctttcaggtattccgctggtgtgacgggacgtatctggaagaccaggacttcttccgttatagcggtgtagggcgcgattgctacttgtatgcccgtgacaagaagcgcattcaggacatccgtgtcactcccgatttggatactgcttataagaacggttccctgaaagtacagcttgatgtgaagggtggcggcaatatcagtcttgaactgctggacgctgccggaaaacaggtggctacagctgtcgccaaaggtaacgctactgccttgataaatgtggagaatcctcataagtggacggcagaaacgccctacttgtataccctgcgtgccactttgcaaggcagcagtgaagtgattcccgtaaaggtgggcttccgaaagatagagctgaaaggaagtcagatacttgtcaacggccagcccgttctcttcaagggagccaaccgccacgagatggatccggacggtggttacgtcatttctcgcgaacgcatgattcaggatattcaggtgatgaagcagttcaacctgaatgccgtgcgcacctgccactatcccgacaataatctctggtacgacctctgcgaccaatatggtatttacgtagtggccgaagccaatatcgaatcccacggaatgggttatggggaagagacacttgccaaacgtgaggactataggaaagcacatatggagcgtaaccagcgcaatgtgcagcgtagcttcaatcatcccagcatcattttctggtctttgggcaacgaagccggctatggcgctaatttcgaagctgcctacgattggataaaggctgaagacccgagccgtgccgtacaatatgaacaagccggtaaaacaggcaagacagacatctattgcccgatgtattatggctatgacggatgtaagaaatacagtgaggatgattctatgacaaagcccctgattcagtgcgaatatgctcatgcgatgggaaactcgcaaggaggttttaaagaatattgggatttggtgcgtaaatattccaaattccaaggtggctttatttgggattttgttgatcagtctgtacgttggacaggaaaaaacggtaagatgatttatgcctacggcggtgactttaaccgttttgatgccagcgacggtaacttctgcgataacggtcttatcagccccgaccgtgtgcccaatccccacatgtatgaggtaggccgtatctatcaggacatctggactactccggccgacttgaagaacggcgaaatcaatgtgttcaatgaatacttcttccgtgatctttctgcctattatatggagtgggaggtactgaaaggcggtaaggtgatacggaccggtcgtgtggataatctgaatgtagctccccaacagacagccaaaatcaagttggacttgggcaagacttgccaatgcaccgagtggttgctgaatgtttcctataagctgaagaaccgtgaaggattgctttccgccggacatgtagtggcaaaagaccagttgacgctcaatccttaccaagctccttccatggaattgaagaactgcgaacagagcaatatcgagatgacggctccccaagtacaggataacgattggaactacctcatcgtctccggtgatgctttccgtgtagaaatcaacaagcacaacggttatctgactaagtacgaagtgaatggccgggatatgattaaagacggcgaggctttaaaaccaaacttctggcgtgcgcctgttgacaacgactacggtgccaatctgcaacgcaaatatatcgcttggaagaatccggaaatcaaactgacctctttcaaacagcgcacggagaacaatcaggtgattgtagaatctgcttacgacatgccgggtgtttcagctaagctgaaccttgtttatgtcatcaacaatgccggtgccgtcaaggtgacccagaagctgactgccgacaagaatgccaaagtatcgaacatgttccgtttcggtctgcagatgcctatgccgcgcagctttgaaaccgttgaatactatggacgcggtccggttgaaaactatattgaccgtaatcattgcgccgacttaggcatttatcgccaaagtgtggctgagcagttctatccctacatccgtccgcaggaaaatggaacaaagaccgatattcgttggtggaagatgttggatcagtctggtaatggcatcaagattgtggcggccgctcccttctccgcatctgccttgcactataccatcgagtctttagatgaaggctggagcaaagagcaaggacactcgcaagaggtggatgaagctgatttgactaatctctgtatcgacaaggtgcaagctggtctgggttgcgaagacagttggggacgtatagcccgtccggaatacctggtgccatacgctgattatgagtttacgttcatcctttttcccgtatgccatagtatcggaatagaataacatttcttctcagtgtattacatactgagaaacagattttataacactgaagcggtcgcctttccgatgggggagggtgaccgctttgtgttgatgttttgcttgcttctgtatatttctttgttttattgtttctgatttcggcaaatgcaatccgtcagatggtcgttgataaaccccgaagcttgcagatgggcatagcaaatggtagagccgaagaacttgaatccccgttttttcatgtctttgctcatggcatctgattcgggagatgataccggaatctcactcaatgactgaaaatgattgataatggggttccggtcggggaagaaggatagcgtatagttgtaaaagctgccgaattctttctgtatgacaagaaactgctttgcattggtgatggtcgacttgattttcagacggtttttcacgatgccgtcaaagtgcatcagccgttccacgtcttcgtcggtcatttgcgccacttgcgcggtatcgaaattgcaaaaggctttgcggtagccttcccgctttttgaggatggttatccagctcagtcccgcctgggcactttccaatacaagaaactcgaatagtgtcttgtcgtctgttaccgtttttccccactcttcatcgtggtatttcacatacagctcgtcggttccgcaccagccgcaacgtccgtttataatgtcttgcataagcgttatttttgtaatgaggtgctaaggtagtgctttcattccgaataaacaaatctatctattctaaatggatagatttgtttattcagaatggaatgtttatatttgtatctgaatataaatgacatagccctatgataagcaaatcggatatagtagaagccatacgtgtgcaacgtgaacggttgaggaaatttcaaagtttccgacgtgacctattgttgtctttacctcccttggtagcagactatgcactgattatatctggtattcgccgttgtggtaagagtacattgctggcacaattatcggtggatagatacaagccggaagaggtgctctccttgaattttgatacccctttactgtatggatttgaattcagtgatttccgtatagtggatgaagttattaaggaacatgaagggtgtatcgctcttctttttgacgaaatacagattgttgatggttgggaggtgtatattcggggcaagttggatgaagggttttatgtgggaatcaccggctccaatgcttcgatgttgagtcgtgaattgggcacgaagttgacaggaagacatattacgaaagaactgttccctttttcgtatgctgaatattgcggttttacgggtaagactatcggtgacagttccttgtacgactatctgcatcagggtggcttccctcaatacttgcaactggatgatcaggatgttctgacggatttagtcaatgatatagtatatcgtgatattgccgtgagatataatatacgtgatgaccactctttgaaaagtctcttggcctatttgatggggaatgtgggcaatctggtgtctgctacaaaactgaaacagatactgggaatgaaaagtacttctactgtgtctgattatttctcttatttcgaacagacttacttgataaactttgttccgaaattttcatattcatataaagcgcaactgttgaacccgaagaaagtgtattgtgtggacaatggtgttgtatttgtcacctctccatctttcacccgtgatgagggtcggaggctggagaacatggtttttgcggaattgcgtcgccgttattctgagatattctattataatgagaaccggaaggaatgcgactttatagttgtacgcaattctgtgccccagcttgccatccaggtatgctatgccttgaccgcagaaaaccggaaaagggaagtagatggcttactggatgccttgtctttcttcaagatggggcatggactgatactcacttataaccaacatgacaaattttccgtaggagataaaacgatagaagcattgccggtgtctgaatattttaaagactaatcttcttgtctcttgcactccaccacatgatacagcgtgccgaaccgtgttctgcgggacggcacttcatgtttctgcagtatccttccgaatacattcactctcttggtggacagcgggatggcgctgtaccggcgcaggcggttcagtatttcggcagacgacagccattctccctcctcgtcatttccggcaacgcggaaatagtggtagaacagttgctcttcgggcggtatctgttcgaaatcgtggttgttttccgtcataatccgttcgtccgactggtcgaaccaatagcgttcgccgtggtccagttcgtgcatggcctgggcataaagctggttgtagtctatcgggcggttggtgtctattgcttccgtcacttctatgcagatgaaccggcgactgccgctggggtcggtcagcaagtccttctggttgctggtggcgatgaacgaggcatatcggcgcatctcgagcacggcattggcgtatggcttgcgcacgttgaccaccggcttctggaggatatgtttcaggaatccttgctgggtgctgcttatctggtcgaattcatcgatgttgatgagcgcaaaacggttgaggtaaagttcggcgtcgcgcttgcgcgagaagtcgatgctgtccgtataataggcacgcagctcgggcgggacgatgcttcggcaaaaggtgcttttgcgggtgccttgtgcacctaccaataagggggagacgctgttggcatatttcttgtcggtattgccgcgccagtgtgccaccatgttgagaaaccagcggtggaacagttcggcccagtacgggttgttgcagggtactgtccgggcgagtgccaggatacggtctttcccgtcccagtgcggaaggtcgtacagataatcttccagcggattgaataccgggatgcggttggagtagatgtaccggctgatgtctctgtcccacaagggaatgccttccgactgtgcatccagtgcaatgctgttcagcgtgcgcttgtcgatgggggagaagcggaaacggaacgagtggcgttcacggtattccacttcgcccacctgggtattgtagcggaagtcgtagcggcgtttcatgaactcgtccgtctgtatggcaagtctttgctctttgctgaggctgctttgggtattgaagcctttgttctcttggtaaacgcttcttacaatctgccggatgacagtctctttttggcgcagataataatggaaataggtacgcttcacggtctcttcttcggggatgcccgaacggaaacagttctcggcaaggcgtacggtcagggagtgcaggctgttgtcggcaccggcacccgtcgcttcggcgaaagtcttctgcaaggcggcttcaaacagcatgatgatggcttcttcggcttcatatcccggcacggcgcgcgtcaggggtgacttctcgtcttgcagggcttcccgataggtggtttcgtcgggcatggagacgggctgtgcaagatagaactgtatggagtccgggcggtacatggcttcggggtcgaaggagaggcgggagtactgttccagcttgggctctttcagcagaatgtcgaaaggcagttggggctggtagcatttcacggcaaggcggtaggcatgggcgtggaatacttcggcttcttcccgtttgcccggcagcgaattgttcggacgggtgaaggtagtccaaatctttacagtccgtccgctggaaccggtgaatacgagccgcgtctggggctgttcccaggcaagacgtttcacaagggctatttcggacttgccggaaagcgggcctacggtcagttccacgatgccgttgtaggttttcatctggcagacaccgttcgtcttgcggaattcggctgccgggagtactttgggcagtcggtctgcctcgttgcagcgcttgccgggcaagcagtatcgcagttgctggcggaaagtggatacgggctgggttttggtctccgttttgattttctgtaggaaggtgtccaagtctgtcgtgctcagtgtcagattcccgtctttttctctcagttgggtgattttcatttctattttttgttttgtcacatgcaggcaaaatggtttgcttacagtgtactaaggtacgacaattaggctctttttgcaagtgattccatgcttttttaggtcgattccagcgtttttctgtggaaaatctgatgttttgagtcgaaaaagctggtgatttgggatgctttgtgcagacttccacgctggttttgcttgtcggaacaatagtttccggctattgaaacaaaaggttttacttgttgaaaccaatggttttcctaagggaaactctcagtttctcttgttgaaacttttgttttagaaggttaaaaccaatagtatttgcttaagaaactaaaagtttcatactgagaactaggcatatagcactattctgtggtgaatgaagtaagtatcggatactgcttttgttatggcgtgatggatggttgtgaagatttttatctatcacgggtatctttcacgctttaatcggtttataatcaaaaggatatccccctctgcgtgatagcatgacagatgtttttcaaaaataaactttgtaagagctgagctgtccggatgcttcaatcgttgtagctgtattcttcgctgtatctctcgaatttcggttcttcggcaattccgtattgtttgaaaacctgacggatatatgcttgtgcctttggaaacaagccttgttcctggcggtaaaagcgataataggtggtcttgccaaagtgtcctacaagctggttcctcatcggggctgcacatttgtggggtacattgtccagcagatgccggatgccccatgctactcggtacttttgggctttccgaaaataagggcagtcggtggtatcggcagggatacggttcgggttgatgatacttaaggtgggatattgcgaggtacaattgatagcggccagatggtgcaggcattcttccttatggatgcactggctgtggaagcaatgcgcaaagccataaggcacagactggtagtcgaatttatttttcatatgttgtttgcttgtctacggttagggtgtagaacacggctgtaaaggtaaggaataaagttgttataacaaggcttttcttgaaggagttagagggggagcacggctctttcatttaagggagttatcgggagttagaaggagttatcgccctctaactccttcaagaaaagcctcgtttgaagtatttgcagacaaaaaaagagtataattcttctttaaagtgagctgaacttgctatatttgtcataattcctaatatctggtatatgaaaaatagagtaagttttttttgtctgcatacgtgtcttctcctgttcagctgttggacaatgtatcctgccttggggcatgcggctgatggggatgttatttcccgtttgaagttcaagcagatttctacattagacggattaccgacggatgaggtccagaaaatatatcaggataaggaagggtttttgtggtttgccacccggtatggtttctgtaaatacgacggttaccagattactgtctataaatcgagcttgaatactcccggtttgttgaccagtaacaacatttattgttttgccgatgacaatgacggcttcttgtggattggtacacaagaggggttgaacacactcaataagaaaaccggagaaatccgtcaatatactgcgcctgccattcccaacaatgcggtctcatgcctgttggtcacccgggaaaatgaggtatggattggtacggattctggcttatgccggtatgtggcagagaaggactccttcgtgatgtatgacggcaagtccaccgatggtatatttcccgcagcttccattaaatcgttgttcgaggactcggatggggatttgtgggtcggtacctggtccagtggtctttttcgttattcccggaaggaggataaattctatgcatatcccaaaatcaatgaacggaactcggcacatgttatctatcaggattcaaaccggaaaatgtgggtcggtggctgggattgcggattatttctcttgaatcacccaaaggatatggcaaacgtgtcttatacgcattattcgcataggataggggatgatgccagcttgtcggacaatattgtttatgatattgtggaggatgtacacacccataccttgtggatagggacccgggtggggctgagcattatgaagcaggagaatcccggtacattcattaattacaagtcgttgcattcggcatatcatataccttgtgatgaaataaattcactgttgcgcgaccgcttcaataatatctggctgggttccattggcggcggtgtcctgatgatagacacgaaacaatctccgtttgctttctattctttgaatctggcagaggatgacgtgcctactactgccgtccgcgctttgtttgccgatgcagataaagacctttggctgggtaccggaagttatgggctggcacgcaaggattatgaaaccggtgtgttgtcgttcttttcccatatcccggaattctcggatattcccagtgtacccacggtcaattacattattcagcgtaagaatggagaagtatggttcgctacctatgacggtggtatcttgatttatgagaaaggagagaaagtgaaggtgctgactgaatccgacacgccttatctctattcggattgcgtttcggccttgtgtgaggacagtaaggggaattgttgggtaggctgtcgcggcggtatgggaatcagtttggccgatggagggcattataggttcggaacactttcttttgccggaggcgggttggcggattggtatcatgtgaaggacattgtggaggatgcggatggcagcttctggattgcgacagccaactatggaattatacatattatgggggatgtgcagcatcccgaaacgctgaaatatagtaactatagttataacaacggccagctggcaacgaactcggtgttgtgtttgcatgtggataaatcgggaaggctatgggccggaactgagggaggagggttgtatctatatgattataaggaaaatgtatttacggaaaagaatcaggaatatcagctgtctgccgacatgatagggtctatagaggaagacaggcaagggtgtctatggatggggactaatatggggctggtacagctttttgtaccgatggacgagaatttggctacggtccgtgtctatacgacagcagacggtctgcaggataactttttcatatcacagtcttcttgcagtagggagggcgagttattctttggaggaaataagggttataacagtttccttcctgcatctctggagaaagacaatgaagccgtgccttatctgattacggatataaaaatcttcaaccgttcttttgcggtattggaaccggaggtcagagaacggatttcttctgtcatgccttcgtttacgcggaagttagatctgccttacggatataataatttcagtattgaattcgcatcccttacttataagaatcccggtttaaatcggtatgcttatcagcttgtaggttttgacaaggattggcaatatacggatgccaaccgccgttttgcctattataataatttgaagagcggtacttatcggttccgtctgaaagccaccaatgaaaatggcatttggagtcaggaaatccgtgaacttgaggtggtggtattaccaccgttctgggctacatggtgggcttatatcatttatgcactgataggggcagctattgtctgcttcattctccggacagcaaagaacaggatgcagctgcgtaatgagctgcatcttcgggagatggagaagtccaaactggaagaactgaatcatgccaaattgcagttctttacaaatatcacgcatgaactgctgactccgctgaccattatctcggctaccgtcgatgagttgaagatgcggtttcccgggcatgacgacctttatacggtaatgggtagcaatatcagcaggctcatccgtctgttgcagcagattcttgaatttcgtaaagcagaaaccggcaatctgaagttgcgtgtctctccaggagatgtggcggcgtttgtgaaaaatgaagccgaatctttcctgccgcttgtcaaaaagcgcaagatacatttctccgtactctgtaatccggagtcgattatcggttattttgatacggacaagctggacaagattctctacaacctgctttccaatgccgccaaatataataaggagggtggctatatacaagtcacgctgatgtatgccgaagacagggacttcgtccggttgcatgtaaaggataatggcagtggcatttcaaaggacaagcagaagagcctcttcaagcggttctacgagggggattaccggaagttcaacaccattggtacgggcatcggcctttctttggtaaaggacttggtggagctgcatggaggaagcattgaagtggagagcgaggaaggccggggaacggaattcatcgtgaccttgcccgtagaccgctcttactttaaggaagaacagattgatgaggaagctgtacttccggtacagaaaaccgttacctatcttgaagaggagaatgcggagaatgtggttgctgaaaagcccaaagcgcataccatactggtggtggaggacaatgaggagcttttgcagttaatggtccggctgctgaaacgtgaatacaatgtccatacggccgaaaacggtcaggaggctgtgactgtgcttgacaatgaggatattgacctgattgtttcggacgtgatgatgcccgtaatggacggcatcgagttttgcaggtatgtgaagaacaagttggaactcagtcatattcccgtgattcttctgacagccaagaacaaggaggaagaccgtgccgaagcttatgaagtgggggcggatgcctttatcagtaaaccgttcaacctggccgtgctgcatgcacgcatccgcaatctgctgaaatacaaagaacgcaaggcgcatgactttaagaaccaactggtgttcgaaatcaaggaactggactataccagcattgatgaggacttcatgcagcgtgccattgactgcgtaaaccgccatctggaagattcagacttcgaccagccccagtttgtggaggagatgggcaccagcaagtccaccctttacaagaaactgaaatccctgacgggactgaatacttctgcctttatccgtaacatccgtctgaaagcggcctgccgcattatggaggagaaggggagttctgtgcgtgtttccgatctggcgtatgccgtcggttttaatgacccgaaatatttcagttcttgtttcaaaaaggaattcggcatgttgccgacggaatatcaggaacgcttcatacagtcatagatcaagtcaaattatgcttcaattaggtcgaataactaaaattctacctcgtagaagcattattggaggtcttcctatcagcattcgcctacatttgccattgttttcacggttaaaatgaagagtgaaagtgaaacaattaatgtttaatcttaaagtttatacaatgaaaagacagagattctttgaaggactcgggctgaaagtgtatgtcactttggccatttgtatggcccttctgttgaatgttcagttcttgaacgcacagagttcgacaatcaatgtaaaaggtgtggttaatgatgcgatgggaccggtgattggcgccagtgtagtggagaaagggaatgcgacgaatggaacaattaccgacattgacggtaatttctctttgaaagtcccttcggatgccactttgacaatcagctttatcggttataagacggtagagctgccggtggctggaaaaacatcctttactgtgactctgaaagaagacagcgaaatgctggacgaggtggtagtggtaggtttcggcacgcagaagaaggtgaacctgacaggttctgtggggctggctacggcgaaggaaattgaagcacgtccggtagcgaatgccacgcaggcattgcagggcttggtaccgggcttgcagattacgaccaataccggtgaactggacaagaatatgtccatcaatatccgtggcaacggtaccatcggtgacggctcaagcggaagtccgctgattttgattgacggtatggaaggtgacatcaatacggtgaatccgcaggacatcgagaatatttctgtattgaaggatgctgccgcttcctctatttatgggtcgcgtgcaccgttcggtgttatcttggtgactaccaagaaaggcaaatcgggcaagccgactatcaactacaacaacagcttccgcttcaacagtccggtgaatctgccggagatgatggactcctatacctttgccaactacttcaatgaggctgcacgcaacggtcaggacaatgcccagttctctgatacagtgatgcagcagatgcttgacttccaggctgcgggaggtactaatcgtggcggtttgcctactgatggcaatgtatggggtaaaccggcaggcgacccgtttactacggcgtatgccaatactgactggttttccgaaatctacaagggctcttccttctcgcaagaacataatttcagtgtaagcggtggtggtgacaagttcaattattatgcttcattgggctatctggatcagaatggtttgctccgtcatggttccgatgacttgaagcgctataatgctactgccaaatttggtgccgagctgaccaaatggttgaagttcaattacagcttgcgttatgtccgtcaagaccttggccgtcctaccaattttggtggcggtttgtatgagagaatcggccgtcagacttggcctaatcttccggtttatgatgaaaacggctattattttaatggtaatgccgatacgccggcgatgtcacttgcattgggtggtgagcgcgatgtgcagacagataaggtttatcatcaagcaagcttggtattcgaacccgtgaagaattggattaccaatgttgagttcaactatagtaccaattctatagatacacgtgaaaccggacttccttactataaccacgatgtgagtggaaatattgtggatacgcaaggaacctcaagtctctatcaagactacaagaaagagagctacatgaactggaatatttactccacttattctcttgctatcaatgatgatcataattttaaggtaatgggtggttttcagtccgaagaaatgcgccagaagttttttagtgccaaaggatatggtttgcaggtggaagaccttccggaactggacttgatttcgaatattgacggcgccggtaaggataaggtgcccgaggtgggtggctatcgtaatgagtgggccacagcgggtttctttggccgcttgaactatgattataaaggtcgttatctggcagaggccaatttgcgctatgatggtacctcccgcttccgccgtggcaatcgttggcagttgtctccctccttctctttgggttggaacattgcccaggaaaacttctgggaagattttgcggatgtttgcaatcagttgaagttccgtttctcttatggtgaactggggaatatgaatacaaacggctggtatcctacttatcgtgccatgacattgaagcaggcaaacggaagctggctgcagaatggactgaaaccaaacactgcttatgtaggcgaccttatcagtacagccttgacttgggagaaagtgcgtacctggaatatcggtcttgactgggggctgttcaacaaccgtctgaccgggtcattcgatgcttatatccgttatacggacaatatggtaggtccgtctgtagagttgcccgctacattgggtattgcgactcccaagaccaataactgtgacttgaagacgaagggttgggaacttaccatcggatggcaggaccgcaccaacttcggtatgggctatggcattaagttcaatgtttctgatgcacgtacttatatagacagatacccgggtaacccgacaaactcaatcaatacttatatcgcaggccgcgagattggtgaaatctggggctttgaaaccgtgggaattgccaagacagatgatgagatgcaggcgcatctgaataaagtgggcggacaaagtgccatcggttccggcgtttggactgccggtgacatcatgtatgccgaccaggatggaaaaccgggcatcaccaaaggtgcacagactttggaggaccacggtgatttgaaggtgataggcaacaatactccccgttatcatttcggtcttgacttgaatgccaattacaagggatttgatgttcgcctcttcttccagggagtgatgaagcgtgactactggcagggttccaatatcttctggggcgttggccaatggggtatgtggtggtcaaccggtttgaaggaacacgaagattacttccgtgatgaacccgtcgggctggccggtcatgagattgccgccaatgtcaattcatactatgcgcgtccgagatttgacagtacccagaaccaggaaacccaaacccgctatctgcaggatgcgtcttatatccgtttgaagaacttccagcttggctacacattgcctgcttccatgattcgcaaaatcggtatcaccaactgccgcatcttcgtatcgggcgagaatctgtggacgggaaccaaactgagcaagttgttcgatcccgaaaccatcagcggtggtaacacggacagcaatgcttctgcacctatcaagagtgccggtaatgcatacccgctttcaagaacttggtcttttggacttagcgtatcactttaatcccataaataatgaagaatattatgaaatcgaattatagatatattgtaaaagcgttcatggcaatggcagtgattgccggaacgacttcctgcgatgattttctggacagagagccgatgtcaagcatttctcccgaaacctattactccactgcggcccagttggaagccaatctgaatgatgaatatcccaatgtccttccgtcattcggccagtggacttatggcatcttcggtgaagacaaaggaaccgataaccagatagaggtgaatgccaatgaccgctatacccaggatcgctggaaagtacctcatagcgaaagtgacaattggaagttcgaacgcatctatcgtattaatttctttttgtctgaagcacttcccaaattcggtgaggacatgagcggttcacaaaatacaatttccgggagtgtagccaccatcaagcactatatcggagaaatgtacttcctgcgtgcttacgagtactttaagaagctccagttgttcggcgacttcccgattatcaaccaaccgcttgccgatgagatggaagctctccgtgaagccagcaaacgttttccgcgtaatgaagtggcacgtttcatcatttccgatcttgacaaggcttatgcctatatgagtgatgtcgatatggcgacgacccgtatcaataaggatgttgcgatgctggttaagtcacgtgtggcactgttcgaggctacttggttgcagaatttcaagggtacggcattcgtacctggtggagaaggctggccgggggcatctcttcacaacaattatcagtatccgagcggaaacattgataatgaagtgaagtacttcttggaacaggccgtagaggcttccaaacttgtagcagataaatacaaagggagtttgacggagaataccggtgtgttgcaacaatcagctgatgacccgtcaaatccttactttgatatgtttgcacaagaagacctttcggatgtgaaggaagtactgttgtggcgccagtatgcccgcggactctctactcataacatcaatgccgctgccggacgtggtaattaccgtatcggtctgacccgtggattcgtacagaatttcctgatgaaggatggtactccggtttatgctcacggttcttatgcggatggtgacggctattatatgggcgacaagacggttgctgatgtacgtgtaaaccgtgacccgcgtctcagtatcttcctgaaagaaccgggacagaagaacatcctttttgaagttgataataatgaaggtacggaagttgtgatggaagagccctatccggccattacgagtggtgacggtgagcgtggctatgctaccggctatgcattgcgcaagggtggttcattcaaccgtaagtattatgccaatggcggtggttatacggcagctgtatgtttccgtgcggctgaggctctgctgaattatatggaagcaagttatctgctcaatggaacgctggatgctacggctcgtgaatattggactgtacttcgtcaacgtgccggcatcagtactgattttgacaagactatcgctgcaacggacatgagcaaggaggctgaaaatgattggggagcctatacgggtggaagtgtcatctctgacaagactctgtataatatccgtcgtgaacgtcgttgcgagttcctggctgaaggtcttcgctacatggacttgtgccgttggcgttctatggaccaactgatgactgctcccagccatctggaaggtatgcatttgtggaatactccgatggaggactggtatctggatgataatggaaaatccattttggttgctgacgggacagacaaggctaatgtctcatcgaaagacaagagtgagtatctccgtccgttcgagagaagcagcaaccagtctgcctataacggctgtacttggaagatggcacactatttgaatcctatcatgatcaagcaattccagttgacagccacttcgggagcggatgtatcgacttccattctttaccagaatccttattggccggtggtagctgaccagccggctgagaaataaaggcatttttcaataggtatttgatttagggggtaggatacactttccggtgagaaggcgtcctgctcccttctttataaatagaaacaagacagagtatgactaattttaatttcaagtttttaggggcatggttggttatcgtagcgtcaatcaccggcctacaggcacaaaatgatttcaccttaaagggaaaggacgaaatggttccggccggagtgtggaacgatgtaaacggggagtatattaatgcacacggtggtggtatactgttatttgacagtaaatattattggttcggtgaacaccgtccggcaaagggattctctacggaagtgggagtaacttgctactcttctaccgatttatgtaactggagatacgagggggtggccttgtctgtatcggaagaagcgggcaatgaaatagagaaaggctgtattatggaacgtcccaaggtgatttacaacaaaaggacgaagaaatttgtcatgtggtttcatttggagctgaagggtaaaggctatgaggctgcccgtgcgggagtggctgtcagtgattctccgacgggaccttatcgttttgtttcttcgagtcgtgtctgccctggaatatttccgctgaatatgacggaggaagaacgggacatgcagtggaatatggaacagtttgaagaatggtggacacccgagtggagagaggctgtaaataaggggttgttcgtgaagcgtgacttggagggcggacagatgtcccgtgacatgacattgtatgttgacgatgatgggatagcttatcatatctactcttcggaagagaatctgaccttgcaaatagccgaactgacagatgactatcaaggacattccggaaaatatgtccgtctctttccggggggacacaatgaggcaccggctatcttcaagaaagacggcacttactggatgataacttccggttgtaccggctgggcgcccaatgcggcgcgtctgttctcggctccttccatctggggaccgtggaaacagcatcccaatccctgccagggcgagggaagtgagcggactttcggcggtcaaagcacttacattttgcagcttcccggcaaccgctaccttttcatggccgatatttggcggcccaagagcctaatgtattcgggatatctctggattccggtccggtttgatgaagaggggatgccttatcttaccctttccggcaaatgcaatccgtcagatggtcgttgataaaccccgaagcttgcagatgggcatagcagatagtagagccgaagaacttgaatccccgttttttcatgtctttgctcatggcatctgattcgggagatgataccggaatctcactcaatgactgaaaatgattgataatggggttccggttggggaagaaggatagcgtatagttgtaaaagctgccgaattctttctgtatggcaagaaacagctttgcattggtgatggtcgacttgattttcagacggtttttcacgatgccgtcaaagtgcatcagccgttccacgtcttcgtcggtcatttgcgccacttgcgtggcatcgaaattgcaaaaggctttgcggtagccttcccgctttttgaggatggttatccagctcagtcccgcctgggcactttccaatacaagaaactcgaatagtgtcttgtcgtctgttaccgtttttccccactcttcatcgtggtatttcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttccaatacaagaaactcgaatagtgtcttgtcgtctgttaccgtttttccccactcttcatcgtggtatttcatatacagctcgtcggttccgcaccagccgcaacgtccgtttgttatgtcttgcataagcgtaattaatatatgtaatgaagtgctaagatattgttttcattgcgaacaaacaaatctatccattcagaatggacagttctcatattctttcttacttttgcaaaaaggtaacgggtcgtttgaacgcctgaaaaacaagaaaattaataataaagaatggaaaagacttggagatggtttggcaagaaagacaagataacccttgccatgttgcaacagataggagtggaaggcgttgtcactgccttgcatgaagttcccaacggtgaaatatggacgttggaagccattgaagatttgagggattatattgaatccttcggattgcgctggtctgtagtagaaagtctgccggtgtgcgaggctgtcaaatatgcggggagtgagcgtgaccgattgatagagaactataagataagccttgccaatctcggcaaggcaggcatccggacggtatgctacaacttcatgccggtgattgactggattcgcacggacttgcaacatccctgggaagacgggacatcttctctttatttcgacagaatccgttttgcctacttcgacctgatgatattggaacgggagaatgcggaagccgattattctccggaagagctggacaaggtggcagaactggataaggtgattacggagtttgaaaaggcagagctggtagatacgattatcgtaaagacacaaggattcgtaaatggcaacatcaaggaaggtgacaaggagccggtaaccctgttcaagcgtttgctggcgctatacaaagggatagaccgggaggctctgcgcgagaatatgcgttatttcttgtctgccatcatgccggtatgcgaggaatatggggtgaatatgtgtgtacaccccgatgaccctccttttcaggtattggggttgccgcgcattgtgacagacgaggcagatattgcctggatactgagtgcagtggacaatccccataatggcctgactttttgcgccggttcattgagtgcgggtgaacagaatgatacccgtgaactggcaaggaagtttgccaggcgtacccactttgtgcatttgcgcagtacgaaggcaataccgggtggaaactttatcgaaagttcccatctggagggaaggggacacctcattgatttgattcgtatctttgagaaagaaaatccgggattgccgatgcgtgtggaccacggtcgcatgatgttgggcgacgaggataaagggtacaatacaggttattcttttcatggccgtatgctggcattggctcaagtggagggaatgctggctgtggtagacgatgaattgtacggaaaatctgtttgattgattttaagttaggcacggattacgcgaaaaatcatggatattcttcatttattatccatgatttttcatgtaatccgtgtctaaagaatctattagtgttgtaaatccggcttaatagttgaaagccctggattttacgtaaaccttgaagtctttgattccacccggtacctcgctttccattctgggtagatattgtatgccggtcagggtgcgggtactacccaagtcaatcacgacagaatgcgggtatggagtgtcttttgttgtgctccaataggttgattcctggaggtcgaagattttgtccgcagaacagttgacgtgggatacgtcttcgctgtcggcataattgacaatccagggttcgcgtgacagacgttccccattctcatccagcagatacatttcggcaatgcaagccaggtcttttccatcttgtgcactcaaggcttccaggcagacataacgtccggtgacgggttggtcgaatttgcgttcctgccaaccgttgccgggattgaagctgccggagaggacgggctgctcaccggacaagtcgagattttcaccctcattgcggtgcgtcagcggtttggtgacgagcaactggtccagtaatggctcgctcagtccttcggacttaacttctttgggaccgatgatgtcgaagacaatcacttcattctcacctttcttcaaccagcatcccgggatgtagagggtctgttgcgggccgatttcccaaatgcgtcccatggcgtgcccgttgacgtagacaagtcccttgccccaagtctcgaagtttaggaatgtgtcgctgggcttgttcaccttaaaggtggcacggtagcaacccggaatgcgttgtcctaactcatctttcagtgagccgatgggctggaacttcatgttcttatagaaatcgtatgtatcttcgagattatagacttcccaatccttcaggttgcaggtgaaaggacggccgtcgatgtctacggtaagttctacgctttgggtgatacccttgaagtccttgatggcacgtccaaagttgatgcggcccatggcttctaccagaatgtcgaggcgtgcacctttggggcaggcggggaattccagttgcttttcaccgttgcggcggtccagtttgccgatgtatttgccatccaggaaaacttgggcataatcgtgcgcatcgttcacagtgagcagggacggggttttcatctcgggcagtgtggtgcggtagagaatacttccgaatccctggttatattcctccatggtacggatattgcggtctttcttggcagcaggaagattgtcgaacaaaggagccatctctgtaaattggaaagacggaatacggatgggcttgattaaagcgggaactttagcctgcttctcgccgttcatgtatttggacaatgcttttcgcaattcccagtatttgggagtggtctgtcccgattcgctgatgggggcgtcgtagtcgtaagaggttacgtcaggggcgaatccgggtgagttggctcctgcccagtgtccccagttggtccctccgtgggtcatgtagaggctgaaggagatgcctttggacaacatctcgtcaatgccggcaatcatgtcggcagccggacgggtttcgtggttggctccccacttgtcgaaccagccgctccagaattcggagcacatcagcgggctatcaggacggagtttcttcagcggtgcaaattgttggtcgatgttggctcctgtaccgaagttcatggtccataccaggtcgtggagtccgttcttggtgaagttggacgcccagtcgcattggaacagtgctacgccggggtagttggcgcgtacgatgtcgcggatttgcgatacgtagcctttgtcttccccgtaggagccgtattcgttctctacttgtaccatgatgatgggacctccgttctgtatggtcataccagctacctgctcggcaacggctttttcgaagatacctacacgctccataaagtaggggtcggattcgcgcaggcggatatcttttttcttgagtaaccaccagggcagtccgcccatttcccattcggcacagacatacggtcccgggcgcaggatgacatacatgtcattctgctggcataggcggcagaattccgccaggtcattctgtccggtgaagtcgaacactcccggctgagactcgtgggagttccagaatacataaaggcagatggtgttcatgcccagtgccttgcatagcttgatgcgttggtcccaataggctttggggatacgtggatagtgcagctctgcggctttgatgacaaacggcttgccattcaataggaatgttcctttgccggcagagaagtcgccttgttcttcccattgggtacgcgggtcccagctgtcgcgccagggtatcgtgattgtgccgtccttgccgaattcaagcgggagccatacgtagcgtgagtcctcaaggtttttctttttccagcggtcgaacatggcaatgtaggcatttccttttccgtatacttgctgcacgtaagtgctttgtgcatagaaggtcttatctgcatcaggaccggtacacggattgccgatggtagtccattgccccatgatggagtcggccacagccagttcggcaacattgggatcccagccggtacaaccggaagagagcatatagtacttgccgttatacttgaatacggcgggtgcttcgcggctttgcttcacgaaattgcgtgtatagcgaccagtgggcttcaggtagtcatccgttagttcgcttatatataaggtagcgttgttttccgacgagtagaactgatatgccttgccgttatcatcaacgaacactgtttggtcgcggctcatcgcaccgttgggacggaagctgcctacataggtgaatgtcccggtaggagaatcgctgaccgctacgccggcacatgccttactgtagtcggcgctttccacatgcgcccacatgacgaatttctttgtcttttcgttgtaaatcactttgggacgttccaacaccttgctggggtgcaggtcgtgtttctcgtcatctttcacggcaggaagtacaataccctcgaacttccagttcagcaggtcttttgaagagtagcagctgacaccggttacgtcggtgcggtagcattcccacgtagcccattcgggcaggatggttcccccttttttgtattcgccataccaatagtaggtcccttcgtggtaaagaaggccgccgccatgggcgttgatgggattgccgtcggtgtctttccatacttccccgggtatgattgcggcatttttcgtttgtgcttttgtttttgcagatggcaggcagcaaaggcaggccagcaatgcaaaactccaaataattttccttttcatttaagaattcggtattagataattaataaatcgtttatgttttgggcaaagatatgcgaaagttgagaaatggagggtatgtaaatgtgtcaaaaaggagagattatagctctaatctctcctttttgtgatgtttttcggtcttttctatttggtttgtacttgtttcatcacccggaggaaatttccaccccatatcttggcgatgtctgtttctgtaaatccatgttccagcagacggacggtgatattgatgaaatcattgtccccattgcatcctttgaccccgcctccaccgtcgaagtccgagccaatgcccacgtggtctatgcctgccacttcaaccatgtgcagcaggtgtttcatgaagtccgtaaggttggttttcttggcatccgggttcaggaactcgtctaccaggcaggcttgagccacaccgccatgtgcggcaagggcgcgtagctgttcgtcggtcagattgcggtcgtgtctgtagatggcgcttgcagaggagtgggagactatgaccggtgcttttgaatatttcagtacatcccagaaggtgctttcggctgcatgggaaaggtctatcattattcccagccggttcatttctttcaccacttttctaccgtaaggacttaagccgttccaacgggcagtcgtgtccgaagaactgtcgcagatgtcattgttgcgggtgtggcaaagggtgatgtaggtaacgcctgcatcatggaaacgggtgatattcttcaaatccttgccgatgccgtatccgttttcgatgccaatataaaaagctttctttccttcggtcttgagcctggacaaatcatcgggcgtgcgggctatggcacattgctccccgttcatctccacttgtcggtagatgtggcgtatcaactcatccactcggtcaatggctttcagactgttctcttcatcgcacgggccttggcgcacccagcatgccaggtattgtccatccaattttccttctcgcatcttgggcaggcaaacctgcgttttttcgcgcgtacctatattataggaaacgtcaaaatcaagtggggtgtctgtatgcgtgtcgagggagaggatgcggcggtgaatctctttggcatgccggtaggtagctgccttttgaaccagaaaatagaagaatctggcagagatgctgtcgcctgccgtagccagagcttcgggatggaattgcacaccccatatcggatattcgtgggaagactctatagcttcgggaatactgtctgacgaccaacccgttacgctgaatcccggggcaacttgcttgaccgcctggtgatggtgagtattggtgaaaagttgtgtctgtccggttatggatgccatggcagaaccgggagtgaggtggacggtatgagttggtatactgctcggttcctgctgctggtggcagacagtggtgtcgggatgctgggtagggatatcctgataaagggttccaccgaaagctacattgattaactgttctccccggcagatgccaaacatcggaatgttacgccgggtagccaggcggatgagtgccatgtcgtatacatcacgcagggagtccacctctcccagctgttcgatgggcgattcattgaaataggaagggtggatgtctcctcctcctatcagaatgataccgtccagctggttggcaatgtctgtcaagacaaggctatcggtagtgatggaaatcagtataggtgttccacctgcctggattacagactcggtatacgtcatctgtgtagatgagcttcggcccggatgtgagcaggaaatgccgatgagaggggctttcctggttgttttttggttggactgtcccattgcccaatatggacatagaacgagcagtgctgttaacagtagtttgttcatggttttcgggggggattctttttcctgcaaagttataagaaatatttaagccgtccaagaagttggatgacttgtgaattcgggcagtttattggcagaagaacattatattctttgttggtggaggaagtgtgttatataacatgcttcccgatgttgcttttctttgaattaatgcctaatttgcgcctcacaaaaagttaacggcatcatcgtatgtcaggttattcacttaaaatcttaatatatcatgaaagtatatcagacgaatgaaattaagaacattgccctccttggcaatgacggctcgggtaaaaccactctcacggaagcgctgctctttgagagtggtattataaaacgtcgcggcaggattactgccaagaatacagtcagcgattacttcccggtggagcaggaatacggctattctgtgttttccaccgttttccatgtggagtggaacggcaagaaactgaatatcattgactgcccgggtagtgatgactttgtaggggctgccatgacggcgctcaacgttacagatactgccattctgctgctgaacgggcaatacggtcccgaggtaggtacgcagaaccatttccgctacaccgagaaactgggcaaaccggttattttcctggtaaaccagctcgataatgaaaagtgcgattatgatatggtgcttgagcagttgcaaaccatatacggtccgaaggtggtgcccgtgcaatatccgctggctaccggaccgaacttcaattcgttgatcgatgtacttttgatgaaaaaatattcgtggggacccgaaggtggcgctcccattattgaagaaattccggccgaagaaatggaaaaggctacagaactgcacaaggctttggtagaagctgcagccgaacatgacgaaggcctgatggaaaaattctttgagcaggactctttgacagaagacgaaatgcgcgaaggtatccgcaagggactggcttcacgaggtatgttcccggtattctgcgtctgtgccggcaaggatatgggtgtacgccgtctgatggagttcctgggtaatgtggtgccgtttgtggacgaaatgccaccggtgcacaatacacgcggtgaggtggtgaagccggattctaacggaccgacttccttgtatttcttcaagactgccgttgagccgcatatcggtgatgttcaatacttcaaggttatgagtggtaaagtgcacgaaggtgatgattttaccaatgcagaccgcggttccaaggaacgcatcgcgcagatttatgcttgtgccggtgccaaccgtatcaaggtagaggaaatggtagccggtgacatcggctgtacagtgaaactgaaggatgtacataccggcaatacattgaacggtaagggctctgaaaaccgtttcaacttcattaaatatccgaactccaaatactcacgtgctatcaagccgttgaacgagtcggatacagaaaagatgatggttgctttgaaccgtatgcgagaggaagacccgacgtgggtgatagaccagtctaaagaattgcgtcagactattgtacacggacaaggtgaattccatttgcgtaccttgaagtggcgtctggaaaacaatgaaaaactgcaaatcaagtttgaagaaccgagaataccgtatcgcgaaacgattaccaaagctgcccgtgcggattatcgccataagaagcagtcgggtggtgcaggccagttcggtgaagttcatctgattgttgagccttactacgaaggcatgccgttgcccgaaacctataaattcaatggtcaggagttcaagatgaacgtcaagggtaccgaagaagttccattggaatggggtggcaagctggtattcgtcaatagtattgtgggtggttccattgatgcacgtttcatgccggccatcttgaagggtatcatgtcacgtatggagcagggaccgttgactggttcgtatgctcgcgatgtacgtgtcatcgtatatgacggaaaaatgcatccggttgactccaatgaaatctcctttatgctggcgggacggaatgcgttcagcgaagcgttcaagaatgcaggcccgaagattctagaacccatttatgacgtggaagtatttgttccgtcggacaagatgggtgatgtgatgggggacttgcagggacgccgtgccatgattatgggtatgagcagcgaggccggttacgaaaaactgagtgctaaggtgcctttgaaggaaatgtcatcctactctacggcacttagctcactgaccggtggacgtgcttcgttcatcatgaagtttgccagctatgaactcgttccgagtgatgtgcaggataaactgattaaggaatttgaggcaaagcaagctgaagaatgattttcaggggttggtagtttggctgttgtaactaccggttgctaatataacaattgttaaagccgttgttacttcatggcaagtaataacggcttttttcattaacgtagattaagaacatgcagaattgtgaattgaatgattaattttttattaaatttgcaaaccaaaggcttgtgtttttgttataatgctcataatacaacctaaaaaatggtcttcggttaatttacgagaacgtccggttaaatcaggttaattggttaggagtgttaattagggagtgttaattttgtgactatgaaaaagtcaactatatggatattaggtgttgttatggggctttccttccttagtttgctgtatctgcagataagctatattgaggaaatggtgaagatgcgtaacggacaatttgatgaatcggtgaagcgtgcgttgatggctgcttcgaaagaggcagagtccgcagaggttgtgcgttggctgaatgaggatatctccgaggcagaaaagaaggcgtgggaacaatcgcagagcagtagcggagtgatgcgtacccagcggtttgtgatgacagctccggatggcagtgtccgttcttcggtggaattgaaaactttcagtaacgagccttctgaattgccaagagcaatgatttcacgcaaacatggagcaaaaaccattcctcagacttcacgctcgcagatagagatgcttaaaaaccgctatctttaccagcgtgcattggtagacgaggtggtgttgcagatggtatacaatgccagcgacaagccgattgaggagcgtgttaatttcaaaagtctggaccagtatctaaaagcaggtctgatagagaatggtctcggtgatatggattatcacttcaaggtgatagaccgggaaggtcgggaggtataccgttgtgcggattatagcgatgcagggagtgaaagctcttattcgcagccattgtttttgaatgacccaccagcccgtatgagtatcgtcaagatacattttccgggaaagaaggattatatcttcgattcggtcaggtttatgataccgtcgatgatatttacttttgtactgctggtgacgttcatctttacgatttacatcgtattccgccagaagaagctgacggagatgaagaatgatttcatcaacaatatgacgcacgagttcaagacgccgatatcgacgatttctctggcggcacagatgttgaaagacccggctgtgggcaagtctccgactatgttccagcatatatcgggtgtcatcaacgatgaaacgaagcgcttgaggttccaggtagaaaaagtgcttcagatgtcgatgtttgaccgtcagaaggctactttgaagaataaggaactggatgccaacgagctgatagcgggtgttatcaacacgtttacactgaaagtggagcgttataatggaaagattgaatcggagcttaaagctaccaactctgccatttttgccgatgagatgcatatcaccaatgtgattttcaatctcatggataatgcagtgaagtataaacgtccggatgcggatctgcaactgacggtgaagacttggaatgagcctggcaaactgatgatttccatccaagataacggcatcggcatcaagaaggagaatttgaaaaagatattcgagaagttctatcgcgtgcatacaggtaatctgcacgatgtgaaaggcttcggcttgggactggcttatgtgaagaagattatcatggatcataagggaactatccgggcagaaagtgaactgaacgtaggaactaaatttattattgcattacctttattaaaaaattgattgatatggacgagaaactgcgtattttattgtgcgaagatgatgaaaatcttggcatgcttttaagagaatatttacaggcaaaaggttacgctgccgagttatatcccgatggagaagcaggatacaaggctttcctgaagaataaatatgacttgtgtgtgtttgatgtgatgatgccgaagaaagacggattcacactggcacaagaagtgcgtgcggccaatgccgaaatacctattatcttcttgacggcaaaaacattgaaggaagatattctggaaggtttcaagattggtgccgatgactacatcaccaagcccttcagtatggaagagctgactttcagaattgaagctatcctgagacgtgttcgcggaaagaagaacaaggagagcaacatctataagattggtaagtttacattcgacacgcagaaacagattctggcgactgccgagaagcagactaaactgaccaccaaagaatccgaactgctgggcttgctttgtgcacatgccaacgaaattctgcagcgtgactttgcgttgaagactatttggattgatgacaactatttcaatgcacgtagtatggatgtatatatcacaaagctgcgtaagcacctgaaagaagatgattcgattgaaatcatcaacattcacggaaaaggatataaactgattactccggaagctgagtcttgatgagactcggctcctctgggggagagaaaataaaaaaggcggtttgcatgtatatgctaaccgccttctttatttcttttcttttgatattagtcgacaattctcttgttgatgacaatgtaggaaatcaatcccactacaaccaaaacggcagaactgcccaagatggcattgttgttaacattgccggtaaaagaacatgcaaccaggattacagctcctattacgactaatatcaatcccagattttttaataagcctttcatgtgtgtgtattttaattagattattatattctttcgtattcttgtcacaaagaaaagcataattctttaacaagcgaaattatttttgcaaaaaatccatattttaataaagaatggaagatgaggaatgaaaaatgacgcttcatccccttgttttctcctcccttaatctctaatccttaacccctaatccctatatcttagtccttcgtattggagaaaatcttcctcagcacctcctggctcacactgagctcttcgatggtgatgcctttcaaggcttctttgagggtctggttggcaatgacgcgcgcgcgttcttccagctccttgccgtccttggtcagatgtatcagattggttcggcggtctttcttgtccgatatgcgcacgacgagatgctgacgctccatattgtctatcaagcgcgtcatgctgggcttgtctttgaaagttgcattacacaactcttgttgcgtcaccccgtccttttcccataagaagatgaggacggtccactgttccggagtaatctccaaaccgttctggcggaagttgcgggacagctttcggttaatggcagccgacactttaccgttcagtatggcaaagataaggcggatatcaaagttgaattgctctatcatgaaattattgtttaaacaactttgcaaagatagtgcaagccgaagacaattcctatatccctacacaaaaaaacattaaatgtttgtagttcaaaataaaatgtctacctttgcaccgcatttttaaaacgaataatttatttatttaattaaacgagtatgaatcaatacgaaaccgttttcattttgactcccgttttgtctgatgttcagatgaaggaagcggtagaaaaattcaaaagcatccttactgctgaaggtgctgagattgtaaatgaagaaaactggggactgaagaagctggcatatcctatccagaagaagtcaaccggtttctatcagctgattgagttcaatgcagaacctactgtcattgagaaattggaaataaacttccgtcgtgatgagcgcgttatccgtttcttgactttcaagcaagacaagtacgctgctgaatatgctgcgaagagaagaagtgttaaatcaactaaaaaggaggattaatcatggcacaacaagttcaatcagaaatcagatatttaactccgccctcagtagacgttaagaagaaaaaatactgccgtttcaaaaagagcggtattaagtacatcgactacaaagatcccgaattcttgaagaaattcttgaatgagcaaggtaaaatccttccgcgtcgtattaccggtacttctttgaagttccaacgtcgtgtagctcaagctgtgaagagagcacgtcacttggcgttgctgccctatgtaactgacatgatgaaataataggaggaggaaagtatggaaattatattgaaagaagacattgtaaacttgggttataagaacgacatcgtaacagtaaagtctggttacggtcgtaactacctcatcccgactggtaaagctgtcatcgcttcaccggctgcaaagaaaatgttggctgaagagctgaaacaacgtgctcacaagctggagaaaatcaaaaaggatgctgaagaactggctgctaagctggaaggcgtatcattgaagattgctactaaggttagctctactggtactatcttcggttctgttggtaacatccagattgctgaagagttggctaaattgggtcacaacatcgatcgtaagattatcgttgttaaggacgcagtgaaagaagttggtaactacaaggctatcgttaagctgcacaaggaagtttctgtagaaattcctttcgaagtagttgctgaagaagcataagaaaagacttaataatgataaggaagcccggttctgataaaggaccgggcttttctatgttcggagcgtatgtgtgtgagcttattgagggatacgtaaagctgcggtttacgcatgctgacatagaagtttacgaatctgaagtagaggtttacgcgcgcggtatagaggtttggcaagaatactcttgtgtctctttacgagattactaatgcaaaaaaaagagcatatccactcaggggtatgctctttgccttattgtcagccaataattcttttagtttcttggcaatgcttctttcactaccatttggcggcctacatattctgctccattcagtttgttgattgcttgttgggcttcagcagcttcgggcatctctacgaaggcaaaaccttttgatctgtttgtattacggtccataatcagttttactgattctactgttccatactcttccattacttgtctcaaatctgattccctaacgttgtagctaaggtttccaatgtacatattcataaaatacaaaaataaaaaattaataattcaataaaggagtcttaggaagttgtagtcagaaatgaaaattctcaatgtggctaatcgaggagaaacatagtgaaacgtagatcgtaataaacctcttattgttttgttgatgcaaagtaacggcttttatttggtatatgcactatactttatcatttatctgccatataatacccttttttgtgaaataagaccaagacttaacaattggaagggaacagaaggagaggataagacataaaaaaagtctggtgtgcttgtatgcacgtcagactttcaattctctcgagtgttgtactgaaattattcagctacaacagctgcgctatctactgctacagtgtcagctgctgcggctgctgctgcggcttcagctgctgctgcttctacagctgcgattgagtcagcgatacggatagaatctgcagttgcttgttcagcgttagctgctttgttgccacaagatgcgaaagatactgctacgatagctgcagccatcaaaactaattttttcattttctttacttttaaaacgtaatacaatcaattgctttattaaaacgttgcaaaggtatgtactttttgaatatgttgttctcgaaaccccaactttttttatattttttttggagcttcggctgtttttatccctatctatatgttttacaacatattaatcttcggcaatgctgttgtataagtatctcttgatactccttttgggcgttttctcaaattctgtcggataaagttggatttggcttactttttcgtaggctgccacgctgttattcagatttttgagattctcatccataatggttttgaggttgtccggctggttcaaccctaaagaatccaaggcttcatagtcggcataaaccagtgccaccagtcttttattccgttcgatgacaagactttccaggacgaaaggcatgttgttgagccgtgcttctatctcttcggggaagatattctgtccactggaactgagaatcatggtcttgctgcgtccgcgtatgtataggttgttgtcgtcgtccagtgtacccaagtcgccggtgcgaagccatccgtcttcggtgaagacttctttggtggcttcggggtttttgtaataacccgtcatcacgttctcaccacgtacttgtatttcgccgagtttgtcgtccgggttttccttgtagatacgggcttccatgatgtcgagtacccgtccggaggaagtcgggacgaattcattccagggagcatagctgatgagaggggcacattcagtcatgccgtagccgatggtgaaggggaacttgatgcgatggaagaattcttctacttccgggttcatggctgcgcctcctatgatgacttccttgaaacgtccccccagtgcgtcaatcagtttcttgcggatttgcccgtatatctgtccgtcgagcaagggaatgctgagcgcccatttcatggtctttttgttgatgatgggctgtatgacattcttgtatatcttttcaatgacaagggggacggtgataatcaggttgggtttcacttcctcgaaagctttcatcagaatctttggggaaggcacttttcccaacagtgtgacgtgtgtgccgacggccgtggcggtaaggaaatcgaatgcgcagccgtatgcatgtgccaaaggcaggaaagagagcactttgtcccctttcttcagcagctcggtacgtatgccgaaggtgacgttgccggccaggttgtttcccgtcagcatgacgcccttactgaatccggtggtgcccgaggtataattcagcagcatgaccttgtcgttggaaaggtccgtgtaaacgatgtcttccttgcggaacccgttcgggtaggtcgcttccatttcatcgcccagatgcttgaggaaacgctggatggtttcgccgtcccgctgatacagacagcggaagtcgctcagcgagaacacaccgcgaattccggtaagccgttcttcttccagatgttcccaaatggcatcgctggtgaagaggaacgtcgattcggagtggtttacgatatgatggacatcattggggttgaagtcttgcagaatggggactacgataccgccgtaggtgatggtggccatataggcgatgcaccagcgggcattgttcttgccgatgacggctatcttgtcgccgcggcgcagttggcagtacttgaaaataaggtgcagtctggctatttcttgtgccacttcgccataagtatagctctcattttctccatagttggtatagcaggggaggtcccaattctcgcggaaactatgctcgtatagtttgataaagttctcttgtatcattgcacaaattttagttgagtgtgcaaaagtaggaaaaatagattaataatgtatatatttgcagcataaatgtgtttataagctcatgatagataccaatatatttcaagataagacggcggtttactatacgttggggtgcaaactgaacttctcggagacctctactatcggtaaaattttgcgggaagcgggcgtacgtacggcgcgcaagggtgagaaagcggatatttgtgtagtgaatacctgctcggtgacggaagtggcagacaagaagtgccgccaggccatccacaaactggtgaagcaacatccgggtgcatttgtcgtggtgaccggttgctatgcccagctgaaaccggagacggtggcaaagatagaaggtgtggacgtcgtgctgggagccgagcagaagaaggacctgctccactacctgggcaatctgcagaagcacgagaccggcgaggcctacacttccgctttgaaggatatacgttcgtttgccccgtcttgttcgcgtggcgaccggacacgcttcttcctgaaagtgcaggacggctgcgattattattgttcctattgcaccattccctttgcccgcggacgtagccgtaacggcagcattgcttctatggtggagcaggccagccaggcggctgccgaaggtggaaaggaaattgtattgaccggcgtcaatatcggagacttcggcaagtctaccggtgagactttcttcgacttggtgaaggcgctggacgaggtggaaggcattgagcgttaccgcatatcctccatcgagccgaatctgctgacagatgaaatcatagaatacgtgtcccgttcccggcgtttcatgcctcatttccatataccgctgcagtcgggcagtgacgaggtgctgaagctgatgcgacgccgttacgataccgccttgtttgcctcgaagataaagaagataaaggaagtgatgcccgattcctttataggggtagacgtgattgtgggtacccgtggagagacggaggagtatttcgggcaggcttatgagtttatcaagagcctggacgtgacgcagctccatgtcttcagctattcggagcgtcccggcacgcaggccttgaagatagaccacgtggtggcacccgaagaaaagcaccgcaggagccagcaattgctggagctttcggacgaaaagacccgtgctttttatgcgcgccatatcgggcagacgatgccggtgttgctggaacgtcccaaacccggactgccgatgcacggcttcactcccaattatatccgtgtggaagtccctcatgatgctgccttggacaaccagctcgtgtctgtgcgcttgggcgatttcaatgccgacggcaccgcactcttgggagcaatggaatgaggaatgccgcctttgcaacaaataactcataacttataactcataactgacgaagtgaaatcaaaaattgtctattggttgacttatgcgggcatgtggcttgtggcacttctgcctttccgggcgctttatgcattgtccgacgggctgtacttcctgatgcgccacgtcgtgcattatcggaagaaagtcgttcgccgcaaccttcgcaattcctttccggagaagtcggaaaccgaattgatggagatagagcgcaagttctaccattatatctgcgactatatgctggaagaggtgaagatgctgcgcatgtctttcgaggagctctgccgccggatgaagtatgataataaggaagaataccttgccatgatagagaagcatggaggcattgtactgttgattccccattatgccaattttgagtggattataggcatgggggccatcatgcatccgggcgacatcccggtgcaggtgtacaaaccgctaagcaataagtatctggacgagatgtttaagcatatccgcgcccggttcggaggatacaatgtggcgaaacattccacggcacgcgaagtgataaagcttcgccgtgaaggcaggcggatagccatcggcctgattacagaccagtcgcccaaccgcagcgaggcccattattggaccactttcttgaatcaggacaccgtgttcatggatggcgccgagcgcattgccaagctgatggacttccccgtcttttattgtgaattggaacggacatccaggggatattgcaaagtgctcttcgatttggttaccgaaactcccaagcagacggcggatggcgagataaccgagtgcttcgcccgtcgtctggagcagaccatccggcgcgaaccggcttattggttctggtctcataaacgctggaaaaataaacgaaaagaatctgtgcaacatggataagattgctgttgtcatattgaattggaacggatgtgatatgctccgttccttccttccctctgttgtgcgtttttcggaggtggatggtgctgtggtgtatgtggcggacaatggctctacggatgcttccgtggcaatgctccgtcgcgagtttccttctgtgcacttgattctgttggaagagaaccacggttttgccgacggatacaatctggcattgaagcaggtggaggcagaatatgtagtgctgctcaactccgatgtagaggtcaccgagcactggcttgtcccgttggcagagtatatggatgcctatccggagacggccgcttgccagccgaagatacgcagttggcgtaacaaggggcagtttgaatatgccggagctgcgggaggtttcatcgaccgctatggctatcccttctgccgcggccgtattatgggcgtggtagaagaggacaaggggcaatacgacacggtgatacccattttctgggctacgggggcggctctgttcatccgtctggcagactaccgggaagcgggtgggctggacggacgtttttttgcccacatggaggagatagatttatgttggcggcttcgtgcccgtggcagacagttggcatgtataccgcagagtgtggtatttcatgtgggaggggccactttgaagaaggagaatccgcgcaagaccttcctcaattttcgtaataaccttgtcatgctttataagaatctgccgcaggaggacttggcgtccgtgatgcatgtacgtgcggtgctcgattatgtggctgcgttcagtttcatgctgaaaggccagttacccaatgctttggccgtattccgtgcgcgccgtgcctaccactccctccgcacttcattagcagcgtcccgcaaagagaatctgaaaaaaactacgcttgccgtaataccggaacggacaaaaaacagtatattggcgcagttttatctgcatggaaagaaattcttttcccaattgtaggaactgttgccttttataattgttcaatctattaaagattttgaattatggaaaaactagttagaaaaatcggattagtggcacacgacgccatgaagaaagacctcatcgagtgggtactgtggaactcggaattgctgatggggcataaattctattgtacgggcaccacgggtacccttatcctcgaagccctccgggagaaacatcctgatgtggagtgggatttcactatccttaaatccggtcctttgggcggtgaccagcagatgggctcgcgcattgtggacggagagattgactatcttttctttttcaccgacccgatgacccttcagccgcacgatacggatgtgaaggcgttgacccgccttgccggtgtggagaacattgtgttctgctgcaaccgcagtacggcagaccatatcatttccagcccgttgtttgtcgacccgacgtatgaacgcactgttcccgattacagcaactacaccaagcggtttgcaaataagccggtggtggccgaagcggtggaatcggcaaagaagcggaaacggaaaaaataaggatgaaactcggttctactgggcattcttaatctatcgctacccttcgttcatggacagcccacactggtgcgatagcccacccttgccgtttgaagtcatagagttgcacaataatggtgttggtgaatctgcccattctatgtcgttgaggtattggtaggggaagcggaactctgtgaggtttattttcaatagttcattccttctgaagtctgcatagttgtatgggtttgtaaagtcgtaaggggtgggcaggtagagggcatttctccaatgaaactcggagctgtatttgatagcaagcggccggtagcaggaagaaagtgacgatggggagtaatgccagtcgttgtatagcgtttctcattgactttttgttgatgatggggcaaaggtacggaatattggtatcaatggtcgtattctacggcagaaaagttgctgcatgctcactgcagaacttctgtatacattttgcagtgctactgcatatctgttgcagcgttactgcaaatatatgtgcagtgttactgcaaaccgtttgcagcgccactgcaaaaagcatgcagtgtctttgcagtgggaagtgtctgtgtatcaatagtgaatggggtgattcggcaatctgtcattctccgcggcgttggcatatttccactcctgcagcctctatatccgcgcccatcggtggattgcgctttgccagcttgagggttatttcctctatctgtgggaagtcgtggaacaatcggtttataattcgcccgcatacatgttccaatagtttggaaggaatgtccatctctgccttcacagctgtatgtacatcggcatagctcacggtgtcggctacgtcgtccgtttctgccgcacgccggatatcaacttgcaggcgcaggctgacggtaaactcattgcctaccacggtttcttgttcgcccacgccgtgatgggcaaagaagcgaagggtgtcaaggaaaatataactggtcattacttgtagattgttttctgcaaacttactgatattttgtggtacgggcaaatcagtatccggttattacgattcaggctgtggattgtattctgtaaaatataaaaatagcgcgaaattgttttttatagaatacaattatgtgagggtcggaataaacttatcgaactattttaggcacggaattatacgggttatcacggttgctttcaatattatccgtgattgtccatgtaatccgtgcctaaaataatactttgctaagaatcctttcttatcttccggtgctttctatcatgctccttattttctcgttcaggctttctgccttcatcagttgttccagtgtcaggtgcatgcgccagcgccagtagtgccgcgggttggcaggaatattgatgcgttcttcctgcacgttcgggttgcgccatttgccgtccatggacatccagtcttgcagggagaggatgcagaggatggagttgctatggaggtgattgcgaaccacttcttcgcagagctccggcgtggccgttgccggtgcggcaccgtagtgcccgagcatggtgttgtagtaacgctgcgtctgttggaagtcttcttcccaccagccgcgcagggtagacatgtcgtgtgtggagatggtgcagaccgaacggtacggataccagtcagtgtggccgaattcttgtttcgggtctttcggcatacgttgtatctccagggaaaggatacgcaggtcgttcatcacccatgccacgcaatcgggaatcatgcctaagtcctcaccgcataccagcatgcgcgtggactgtgtcagttgcggtagtttcttcatggcttgctgtccccagaagtcattgtggcggtgatagtagtactggtcatacagccggttgaaggcagccttttcccaatcgttcagtgcgcggtagatgtagtcgtgctgcacgccgatgcgcggatggtattcgtgcggattgttgcggtcgggcacgaacagcacatcgctgataagggcgtaaagcccgtcacgaatccagatgctgtcatcgtccgtctttccggcaaagtaggcttccactttgcgctgggtgtcgaactcgggacgcatgcggtaaacctcccacgtgtctgtcggctctatgaaggtctgcttcacatagtctgtatgcgggccgaagatttgtccgaggaagtactcatggatatagggcttcaggaagaagtcttcgcggaatgccagcccgtagctttctatctcctcgcgcgtcatgggcagggcggggacgaattgtcccaacagcccgtgtacggcgtgcatcggtatctcccaaatgcggaagaagccgaggatatggtctatgcggtaggcatcgaagtattctgccattttgtggaaacgcttcatccaccaggcatagccgtctttctccatgacatcccagttgtaggtgggaaagccccagttctgcccgttcacggagaaatcatcgggcggtgcgccggcttggccgttcaggttgaagtagtggggttccttccaggcttccacactgttgcggctgatgccgatggggatgtcgcctttcagcactacgccgttggcgcgcgcatgctccgtggcggcaagcagttgccggtgcaggttgaactggatgtaataatagatggctatgtgcggatagtcggcggagtccggccggcacaatgtctctatctctttggcatcgtaggtggcatacttgggccactcgtggaaattcggggtcttgtaggcatcacgcaggtagctgaagacggcatatggctgcaaccattccttgttggcttcgtagaaattacggaaagcatccgatgccagcaccttttccccttcctgcttgaagatgaggtggaagtattcccactttgtcttgttcacagcttcgtagtctacggcgggcagggcattcagttctttctggcgtttgttgaattcggccatcaccttcttgtccttcaagctgcccaactgcttcaggtcggcgtacatgggatggaaggcatagatggagatgctactgtaagggtaggagtctgtccaggtatgcgtcatggtagtgtcgttgatgggcagaatctgcactgccttctgattggtggcaactgcccagtcaatcatgcgcttcaagtcgccgaaatcgcctacaccgaagcttttctcggagcgtagggagaatacgggtacggctactccggaacctttccatgcaggaagattgaagtatacataacggtcgccgacagccagcgtttcgttggcggctatctgcgggtcggccatataacggttgggattgttctcccaggccacggcacggcgctctttcttgttgtaaaggacgaatttatattccagcgggaagctgattttaccggcatccacttctacctgccattcggggaagtcgatgtcgctcataagggcagctttgtccgggttccagtcacccagcgccttctggtttccgcagagtgccaggcaatggtcgctgtctatgcagggggcgtacgcctttatcagcaacccctttttgtagcttttcggggcggcactgcgttcgcgatgcgccagcagggattctgtgaaagcggatgtataaaaatactgctgctcgggcagattcttccaacaatcttctatgcggtaaactttcttcggattgtctgcaacgtgcaggatgcgtggcaggctgttccactctgtccgtatggttctgccatctcgatagatgtggtaactgtattcgacgcttccattaccgggaatctggatatccacttccgcggtccagtgaatgccgtctacagtgtgcaggggggtggctttgtcgggctggttgttgccaagttccgggatggaacccaggactctgacttcttcaccccagctggtacgatactcgatattgaatattagtgtcatattatattagatttagaagtagcaatagctgcaatgattatgcaagtatagaaattattcctcataatcatgcagctaccgttatctaagtcatttaaattcctatgcaaacgtttgtgcttgccgtgggattatccacagcgagaagctccgcacgtcttgcagatgaggcaaccttcttggtaaaccagtgtttcgttaccgcagttggggcatttcttgcctttggcttccgtgccgtcctggatgtatttcttcagggcgcgttccacaccgttcttccaggtgttgatgttttcgctgtccagttgcagtgaacctaccagcttgatgacctgctcgataggcatgcggtagcgcaatacaccggaaatcagcttggcatagttccaatactctttgttgaacttctcagacagaccctcgatggtgactttgtatccgcgcttgttctcgaactggaagtcgtaacgcttgtttccgtgctcatccacattcttgatgatgtggcccgacaccacattcttcggcaggatgatgccttcatcatcatccagcacaccggtgaatatttcgtagggatgattgtccagcaagccgacgaatgccacccatttctccttgttgttctggaagcggacaacgtctgcatccaatattctgggacgtgtttcaacgactgtaggcggtttgcacgggggaagctcggacttcttgtcgctcttggtagagatgagcacgccggaacgcgaaccgtcgcggtaaaccgtacagcccttgcagccggatttccatgcttctacatacagacggttcacgaggtcttcgtctacgtcgttcggcaggttgatggttacgctgatagagtggtccacccatttttggatacgtccctgcatcttgactttcatcagccagtccacgtcgttggaggttgctttataataaggtgatttctctaccagggcatccacttcttcctgcgtgtagcgtttggcggggttgtatccttgtgcttccatccaagtcacgaacttggggtggaacacgatatattcttcaaaggcatctccggtttcgtcgatgaagtccacatggacgttcgtatcgttgggattcactttgcggcggcgcttgtacacgggcaggaatacgggctcgataccggaggtggtttgagtcatcaggctggtggtgccggtcggggcgatggtcagacaggcaatgttgcggcgtccgtacttcttcatctcctcgtacatttccgggtcagcttcacgcaggcggttgatgaacgggttgttcttttcgcgttctgtatcgtatacctcgaatgcgccgcgttctttggccatttctatggaggagcgataggcgttgagtgccaccgtcttgtgtacttgctccgagaattcggttgcctcttcagtgccataacgcaatcccagggcggcaagcatgtcgccttctgccgtgatacctacaccggtacggcggccttgggcgcttttcttgtaaatcttctgccacaaaacgcgttctgtatgtttcacgtcttcactttcggggtcggcatctatcttgctcatgatgcgctctatcttctccagttcaaggtcgatgatatcgtccatgatgcgttgggccaaagctacatgcttcttgaatagctcaaagtcaaagtaggcgtccggcttgaacggattgaccacgtatgagtaaaggttgatggcgagcagacggcaggagtcgtacgggcacagtggaatttcgccgcatggattggtggatacggtacggtagcccaggtctgcatagcagtcgggcacggattcctttaatatggtatcccagaacaatacaccgggttctgccgatttccatgcattgtgcacaatctttttccataatgcggatgcgtcaatgtctttttgaaatgccggctctgtggcgtcaatcggatattgctgtgtatatggtttgccttcgatggcggcctgcatgaagtcgtcggtcagttttacggaaacgttggctccggtcactttgccctcagtcatcttggcatcgatgaaggcttccgagtcggggtgtttgatggatacgctgagcatcagtgcgccgcggcgtccatcttgagctacttcgcgtgtagagtttgaatagcgttccatgaagggaaccaagccggtggaggtcagtgccgagttctttaccggtgaacctttcggacggatatgggataagtcgtgtcccacgccgccacggcgtttcatcagctgtacttgttcttcgtctatcttgaagatggcaccataagaatccgcttcgccgtccacaccgataacaaagcagttggacagagaggctacctgatagttgtttccgattccggtcatcgggcttccttgcggaacaatgtacttgaagtggtcgagtaagccgaaaagttcctctgaacttaatggattggggtacttggcctcaatgcgggctacctcattggctattcgccaatgcatgtcttccggagacttttcgtaaatatttccgaaagaatctttgactgcatatttgtttacccaaactctggcagccaactcgtcgccttggaagtattttaaagattctccgtaggcttcgtcataagaataatttttcttttccacaatgttgtatctcttaggattagttacaaataagtaaagttgtagaagttgtacttatcgttaacaaatgcatttgcaaagctatgaatgtttttcaacttggcaaaattaaaatgaatgtttttatcaaccgatgtatagttttctattgattgctattaatttattggtttataatgttttaatgatttgagtaaacgaataagttttccaaaatggaatttattaacaacttgttgggctgaaaggttctcggtttagtcgaacataaggttacttttatctgctcgtagagataataattgttcatttcttgttgaaaagatgtattttattccggatatatgatgataaaaaaagtgtgaactcttgaatgaattgttcgtggattacattatctttgcaaaaaaagaaagaatggaaagcttgaaacaaaggagaacaatccgaaaataccagcagaaggatatttctgctgatttgttaaatgatttgcttgaaacctctttccgggcttctacagtcgggaacatgcaggtttatagtgtgattgtgacgcgtgatgcagagcgtaaagccaaactggcgcctgcacatttcaatcagccgatggttcggacggcgccggtagtgcttactttctgcatagatttgcgccgcttcagcaagtggtgtgagcaacgtaaggctgagccgggatacaacaactttgagtggtttgtgacgggggctgtcgataccttgctggtggcacagactttttgtgtggctgccgaggagaaggggttgggcatttgctatctgggaactaccacttacaaccctcagatgattgtcgaagcgttggagttgccggaattggtgtttcccatcacgacagtcacagtgggatggcctgccgaacagccggaacaagtggaccgtttgccgctggaggccattgtacacgaagaggtttatcatgattatactcctcaggacattgaccggttgtatgcctataaagaatcgcttcttgagaacaagcagttcatcttggagaacaataaggaaacgctggcgcaggtctttacagatgtgcgttatacgaagaaagacagtgaggcaatgtcggagaatctttggaagataatgaaaaagcagggattttgaaaattaaggataagggataaggggttaagctaatgcatacttagctgcatttaatcccttatcctttattcttatccttttttcagtgcggcttgaatctcgtcgatttccgcacggaatgatttgtccacctctttcagttctttgatggttttacatgcatgcaatacggtggcatggtctttatgtccaattagcgcaccgatttttgcagtagagaagtctgtatggtttttggctaaatacatggctatttgtcgtgcttgcaccacttcccgctttctggattttgtgtggatggtggcagtttccaatccgaagtgcttgcatacggtgttgatgatttcatcgacagtcactgccttgctttcgctgttcactaccttgcggacgatacgttgcgtcagttccaggtctatttctttattgtatatggtggaatgcgccataatggaaatgacgatgccctccaggtcacgtacactgtcgcccacgttctctgcaatatagtcaatcacttcctgggggaactgcaggccgtcacggtgtatcttgttgcgcagaatgttcttgcggagttctacggtaggtttctccagctcagccaccattccccatttaaaacgtgtaatcagacgctcttccatgccctgcagcaataccggtgcacggtcggaagtgaggatgagctgcttgccgttctgatgcagatggttgaagatatggaagaatgtattctgcgttttggtcacgccggcaaattcctgaatatcatcaatgattagaatatcaatggtctggtagaagttgatgaagtcgttagtcgtattgttacgtacggaatcggtgtattgcacttggaataggtgtgcagatacatacaatacccttttctccgggtatagttccttgattttggttccgatagcattggcaagatgggttttgcctacacctgatgctccgtataggaacagcggattgaagattgttttagccggattgagagcgacagcttctgcaacgctgcgcgacagcttgttgctgtaaccttcgatgaaggtttcaaagttgtattctggattaaggtgcgggtcaagttcggggacgggaatctgcggaatccttttgtccatcacttgtttttgcggtatgatggtacgctgtgtagactccaggtcgacggttttccgcgagctcttgtccaccattacgttatacatcaatttagttccctcaccaatgaccttatagagagtcttgcgcaacaaatcaacaaatttgtcctccaaaaactcatagaagaactggctgggcacttgtacgaccagcgttttgtcttcatattttaaaggtatgatgggaagaaaccatgttttgtatgtctgctccggaacattgtctctgatgatttcaagacagcggttccacagcccgacatgatctatttcactcataacggctataaatacatttattaattaagcataacttctacgattgcaaaattggcaatcttattcgagaaaaacaaatcctttttttcttgcgtttttagggaaagtaataagctctttactttcagctacttatcggttactatgagtatactccttatataaggtgtgttgcatttatctaatactttgtcatatagtggtttatgtagctttgcgtctcttgttttctttctgtgcccagagcaggaaaaagccctttttcgctccttgtatagagcaaatgagggctttccttttaattcctttatagacttgttatttagacaaaatctatataacgtccatcttttacttatctttcttgccgaatagggagaaatggacgtatcgtttcggatgcgatttcaagtcttccaataaacttgctgcgttggcagtggtggcgttcagattattatatagagaagggtcgtttagcaaaagtccgacggtattgtctttctggttcaatttgtctgtaatcatttttacattgttcaaagttgcgtctaccttttgcatggcggcagcataatctatctcctttaagttgttggaaatgagtgcaaagttgtctccaatggtattgagcttgccggtcagttgtggaatatcatccttcattagagtttgcaactggcggcttgtgacggccatacttgctgttaaatcttgtacgttatgcaaggttgcagggatggcggggtcggctagtatgacatttaaggatgcgaggatggaatccagcttgggcagcatcttctctacttgcggcatcatggtggcaactttttccatcattccgttgttcagcacgccggggattgtgtctccaatctggtatttctcccgtgggttattggcaagcagcaggttcatctttacgccgccaagcatttcggctgccagttctgccgtacttcctttgggaatgcgcagctctgggtcaacatctatttcggcaacgactttgcccggttgggtatagtcgtagtacaagtcgcggacaatacccacgcggaagccgtcggcaaagaccgggctggattttgtcagcccattgacattctggaatttcacgtagaaatagctggagggcttgaacatatttatccctttcaggtagttgatgccgtataccaatatgcaaagtgcagctatgcctgctattcctattctaacttcttttgtaatatacttcatgatgtatcttttgttatttatttctgttctttttaaattcgctgatggctgtgttgacgtttatcttttctccattcttgaacgcaatgatgaatgcgtccttgaatttgtccgtaatgctacgtttgctgcgcagcaccttgttgtaatcgggtgatgcgccgtacgtatatttgtagattccgccttctttataataatccacgtctttcagtcctttcagtcttttgtcattcttggccagaggacgtgaagaagtgagtatctgtatcttaaacacgatgccgctctgttctgtttgggaaacggctgcattttctgacctttgcgggcgttgggcagcttggttactctccgcttgaggtgcatttttcttttccggtgtcgctgtagctgcgttgccttcttcttgaacgggctcgggtacatcctccggaagaatggtattgctgcttccgttcaaccggatttcctgctcgcgcttataggtgaggaaagcgcggaagataccgttggcaagtgaggtggttcctgcttcagtgttcaggtaccgttcctcttccggtgtggagatgaatccgagttccaccagtatgcttggcatggcactggccttcaataccagaaaacctgcctggtgcacgccccgatctgtacgtttgcaggtttggcggaaatgcttttgtacgagggaggcgaggtgcacactctgtgacatgtatttgtcttgcatgaattcgaagatgatgtaggactctgccgagttgggattgaagccggcataccgcgtcttgtagtcgctttcgtagaggataacggcattttcgcgcttggctacttccagattggcatccgattttgccagacccagtgtccaggtggaggctcctttggccgtccggtttttggccagggcattggtatgtatggagatgaacaaatcagctttggcgttattggcaatttcagcgcgccggtccagggggatgaatatgtcccggtcccgcgtatagataacttttacatcagggcagttcttcttgatttgtttgccaagtttgagtgctacattcaggttgatattcttctctttggaaatttttcccactgcacccgggtcgtgtccaccgtgtccggggtctataacgacaacaaagtctttcgcttcagcgctgccactgcaaaagggggagataagcagccctaagcatatacttatatataatatgtatcgtctgtatagtttcatataattgtagcaaagacaatgcttccttttcgcttggcaaatgtagtggaaatttatagaaaactaatggattatgttcagttttattgttcttcttctcatttttagtgtaattaatgtctgtgtttgagtaattagtgactcaatgtattgataatatgcgtaactttgcggcagataattaaaatagcaaatcaagtatgctggttcgttttataaagaactggacgttgcctttggcaatgcttgccggtactttgggatatttcttttttgcagacattccttttgtggagcctgccaaaccttatgtgaatgggttagtggctttcctgactccgcttttgattttttcccaacttctgctcactttctgcaaggtggaggtgcatgaactgaaacccaaatcgtggcatggatggttactgctgttccagacggtttcttgcttgattgttgcggtattgttggtgtgttgccctatggaggaggtctaccgggaagtgtttgaaggtgcaatggtctgcctcatttgtcccactgcaaccgctgcggctgtcattaccggtaaactgggtggaagcgcatccagcctgacgacctatacgttgttgtccaatcttctggcagctgtggctgttcctttggttttcccgttggtggagcctcatgctgacattactttttttgttgcattcctgaaaattctgagtaaagtctttccattgctgctttgtcctttcttgctggcatggtttctgcgtgcgtttgtgccgaaggtgcatcattttctgttgggtttccatgatgcagccttctatttgtgggcggtagctcttgccattgtctcagggcagacggtacgttcattggtcaatagtgatgcaccggtatttgttgaactgctgatagccctggcgggactgataacctgctgtatacaattctatttgggaaagagaatcggcggtcattatggtgagcgcatcagtggagggcaggcgctggggcaaaagaatacggtgcttgccatctggatggcatatacttatcttaatccgttatcttccgtcggtccgggatcgtatgtgctgtggcagaatattattaatagctggcagttgtggaaaaagagaaagaatgagataaaataatgaatataatctattgatatttaggtgtttgctatttgtatccaacttttcctttgtttttcctattttcctgcttattccaataaatgcgtttattttgttaccagtttgttacttgaatagcattgagtaacaaaaaaaatatctatatttgccatcggtaacaaaataaaaacataagtatggcgaagaagaaacaagaggctaaattgaaggagcctgtaagaatccggtttaagcaacttgccaatggtaaccagtctatatatttggactattacacaggtgatgttattcggaaagaaaactatgttggcggtaagcgtcagtatgagtttttgaaactctatcttattcctgaaaagacaagggaagataaggcaaagaatgaaactacgctggctcttgccaaagcgattcaaagcaagcggatagtagagctacagaatgatgcgcatggatttcagaacactaataagtcaaaagcgaatgtaattgactatttggtgaacatgagaaaccaatctaaagagcgtggtagcttgaattatgaaaagactattggtaacactatccgtgaattgaaactattcagaggggactatatcgctttccgtgatatagacaaagatttccttagtaactttgtggatttcttaaaacaagccaagaaagcaagcaaatacggattggcaaaagcaggaggagtgttaagtaataattcggtagtcgcttattacggagtattgtgcaccgctctgaataaagcatttaaagaaggatttataaccattaatcctactaaggaatttaactttgccgataaggtaaaagcggaagcgagccgtagggagtatctgacgatagaagaactgaaactgcttatagctactgaatgtaagtatgagataatgaagcaagcctttcttttcagttgtttgtgtggattacgggtaagcgacataagaaagttgaaatggagtgatttacagaaaagcggtgaaaggattagaattgaaataaagatgcagaaaaccaaagagccgctttacttgcctatatctgatgaagccttaaagtggctgccacagcggggggaagcgaaagatgatgattttattttccctttgacacatgagggtactataaataatatacttcaaaaatgggcgaaagcagcaggagtaactaagcatatctcatttcatgttgcaagacatacccacgctaccatgatgttaacattaggtgcagatttatacacagttagcaagttattggggcataagaacattgctacaactcaaatttatgccaagattgtagataaaaagaaagaagaagcgataagtttgataccaaacttaacggattaatttaaaaagaaagaaagtacggaacgctgatagccgcactttctttctttttttgcctatgttttactggaaaaatatatctttgccgctactaactgaaacagagcatattatgacagaagaagaactgaaagtaaaattcgattatatacaaggcatattcaaccgttgcataaactatgcctgccaaattttgatagacagtatcatcgtcaaggttcgatacttgaatggagaacaggctgatgaactggaacgtcaggaatatatacatgctgttaatgaattagcgcaactatatatccgttattcagcactgaatgacatccaaaatttctactctgtacccgatttcttttgggaaagcggtttttatgaagccttgaagcctgatgaaaaaagaaaatatctttcattctctcctctttcgttcaattattcccaatatgcgcaggataatacagtttacgatgaagaactaccttatttctccatgacagtaaaagctgttgtgttggaaagatattcggcatacttgcgaaaaaagaaagaggatagagcgcaggtagaaacacagccgcaacaggaacaggtagaactgaatccggagccaactatcgtttctccagtaatagccgtacctcccgtcgctgaaacggaaaatcagtttgaatcaattcttaatgacggtcagatagaattgattgcggaatgtatgaatgaggttaagatgttcaatgcccccgtaacttctgacgacctgaaagcgatactctcttgcaagcccaaagtcatattcaggtctaataataacaggtatctcgcttttcttttttcagagttgagctatcgcaacctgattacccccaattggcaatcggttattgccaaccataaactctttctttccaaagacaaaagtagggataaatacctcaatcaaggtgatttagccacagctacgaattatgtgaaagacatagaccatgtgaaaggatatgcaatcatagacaagtatatcaaacaactgaaaaaactttaagaacaggttaagacctcaaacataacttaatccgctatcaagctattactcaatacttttgcccccgtaatcgattacaagtaaacggagggcatgcactccatattgtttcacgcaaatacttatatagtatgagtaagagtattgagatgcgagttgaagaactcgaaaatttagtgttcctttcaaaaaacgtgcttagtttcgaggaagcaagcaagtttttaaacctttccaaaagttacctgtataaactgacttcgggtaacctgataccgcactacaaaccgcagggcaagatgctttattttgagaaagcagagttggaagcgtggctacgtcaaaatcctgtaaagacacaagcgcagatagaacaggaagcgcagaagtatgttcttaaccgtcccttaaaaaagtaagtctatggaaaacaagaaaggaacggaaacgcaaaagatgacgagggaagattttgctgtcctttggaaaaccattcatctaaagataatcgacacttacgatgtaccgcccgaaatactttgggtaaatggctctactatcggcacattgggaaatttcagtgcatctacaggtaaggcaaagagtaaaaagacattcaacgtttccgccattgtggcggcagcgttgaagaatgacgaagttctgcaatattcggctttcctaccggaaaataaacgtaaaattctttatgtagataccgaacagagtaaataccactgtcacaaggtaatggaacgtattatgtgtttggcaggtcttcccaccgataaagacagggatgattttatttttgtcgtcttgcgggaatgtacaccggataagcgtaagcagataatcgactatatgcttgccaatatggaagatataggacttgttatcatagatggcatacgtgacttgatgtatgacatcaatagtccgagcgaatcatccgaactgataaatctcttgatgaagtggtcgagtgaatacaatctacatattcacactgtcttgcatctgaacaaaggggatgacaatacgcgagggcatattggtacggagcttaacaataaggctgaaacggtcttgcaggttactaaaagcactcaagacgtaaatatcagtgaagtaaaagcgatgcatatccgtgataaagatttcgagccgtttgcatttcgtattaatgatagtgcgcttcctgaaatagcggaagattacatttttgaacagcccaagcaagaccgtagttttccgcttacagagttgaccgagctacaacaccgtgaagcattgactaacggctttggtaaacaagtgatacaaggttatcctaaagtgatagctgccttaaaggagggttacgcaagtatcggttttgaacgtgggcgcaatgtgcttgtgaagctgaataagtttcttgtaaacaagcgaatgcttgtaaaagagggtaaaggttataagtataaccctgatttccactactaacaataggtttggtttagtccgtgtgtatatataagaggaatgaacttcttttgatactgtaagtacaaagtaagtttagtacagttcaggcgtatatatgactaaacggaatttgtttcaattattcaatcatcaatacatttagattatgacaatcgaagaatccaaaaatataaagttggcagactatttgcacagtttgggatataatcccgtgaaacaacaaggcagcagtctttggtataaatcaccattcagggaagagaaagaaccctctttcaaagtgaatcctgaccgcaatttgtggtatgatttcggattaggcaaaggtggcaacatcattgcattggcgcaagaactctacgcatccgacagtgtgccgtaccttttagataagattgcgcagcaggcattacacgtccgtcctgtttctttctcttttcggcagcaatcttctacacagccgagttttcagcagttggaagttgtgccgctttcttctcctgccttgtattcttacttgcaggagagggggataaatacggaactggcaaaaagagaatgtaaggaagtccgttttgtgaataatggcaaacagttctttgctgttggttttccgaatgcttcgggtgggtacgaggtacgcaacaagtattttaaaggttgtatcgcacccaaagacatcacttatatacgacagaagggagagccgagagaaacctgctacatgttcgagggatttatggattatctttcttttctgaccctacggcagaaatcctgtcttacctatcccgaccttgacaagcaagactacatcattttgaactccgtttccaatctctctaaagcgttgtacccgttagggaattatgaacatatacattgctttttcgataacgatgcggcaggaatgaaagccgtgcaggaattgcatcgggaatacggctggcgtgtccgagattcttctcgtatctacagtaactataaagatttgaacgactatcttacgggtaagaaattgtcgcagtcgttagagttcccacaaccgacaaaacagaccgaaaggcaggtgcagcaaccaaccaagaagaaaggcaaaggttttaggatgtaaccgccgcacgcacccacaggcttttaagtaaagaaaagccatagctcaatagggcgttttcttaacgcagtgcaagcaccgctaaaaacaccctatcgagcaaaggggcgatgccccttttgaaaccccgtgagccatgcggcacgtatgcaaggcaagcggaattgtctaacgaaaaaatgtaattcaatatgggatattttacccttgatttcaagaaagcaaaaggcgcatccgatgcccggatgtccgaccacattgaacgccgggtgatagcgtctaacgttgaccccacacgaacgcatctcaatcgggaacttgtacaacttcccaaaggagtaacggaacgtgacgaagcgatagcccaccgcatcaagtcggcaggcatcaagcgcaaaattacgcctgaccaagtaagggctattcgtgttatgctgtcgggaacgcacgaggacatgatgaagatacaacaggacggacgtatagatgaatggtgtgacgatagtatgcaatggttgcacaagactttcggaaaggagaacaccgtttccgcagttcttcacatggacgaaaccacaccgcacatacatgctaccattgtgccgatagtaatgggtgagcgcagaaaggcgaagcagaaaaagcaaacggagggaaaacgtacctatcgcaagaaaaccgatgcagcccgattgtgtgcagatgatgtgttgaaccgtgataggttggtagcctatcatgatgattacgctaaagttatggagagatacggtttgcagcgtggtgtacgtggatcggaagccagacataccactacagcccaatattaccgcgatttgaaacgacagacgggtgaactcgaaacagacgtgcagcaactccaatccgaaaagaaagcagcggagaaacgactactacaaatcaaaagagaaatcggcacagaacggctggaagtggttaagacagaagctaaaaccgccattatcgcaaaggtaggttctcttttgggcagtggagaaatcaaagaactgaaacaggagaaccagcagcttcgtgatgaagttgttgctcgtgacgagagcatcgaaagactgcaaattatgatgcagaagcaacgggaacagtacagcagggaattggtaaaagtgcagggtaagcacatcaaggaactggatgaaacccgaaaggagatatcacggctgtcacagatgattaaaaaggcttgtgcatggctaccactactaaaagaacttttccgaatggaaaggctatgtcgtgttgtcggtttctcaactgaacaaacagcaaaactgatgttaggggaaaagatagaacataatggcacactctattccgaagagtataaacggaatttcgtaacggataaggtgactgcacaaatagtaacagcttcaactgttggaaagaacaaattggtgctaatcatcaatcgaaaaaatgtttccgattggttcagggagcagtttagcaaactctatcaaaggatacaaccgaaagaggagcagaaaaggagcaaaggttttagcctgtaaagagaggtatttggctgaaatacagtaaaaagtacaattcacaatgaatgatactgtaccttttgctatatttgcatataatcaatttaatattaaaagaatgaatgaagattttgattatttagaaataaaccggaagtcttggaacaacagggtagatgtgcatttgaaatctgacttttacgatgtcgaaggctttttgaaaggtgagtcgtctctcaatgatatagaacttggtttacttggagatataaaagggaaatctattctgcatttacaatgccatttcggacaagatactatttcgttgggtagacttggcgcaaatgttacaggtgttgatttatccgataaagcgattgaccatgcaaagatattagccgggaaagcaaatgttaatgcaacttttatctgctgtgatatttatgatttgcctgctcatttgaatgaacaattcgacatcatatttacaagctatggagtgattggctggttgccggatatgaataagtgggctcagattatttcaaattatctaaaaccaaatgggaagtttgtatttgtggagtttcatccgattgtgtggatgtttgatgatgactttaaaaggattgaatataactacttcaattccggtgcaatcagagaaacacaagagggaacctatacggacggggaaaatgatttgttgcaagaatgtgtaacgtggaatcatagtttgagggaggttataaatagccttatacaaagtgggcttaccatatcttcttttgatgaatttgattattcaccctataattgtttttcccaaacagttgaatgtgaacctaacaaatataggataaaacatttgagtaatcatattccgatggtctattctataatagctacaaaataagaaaggctggaaagaatttaatataatagatatgaaaacggattttacaatcaggcaagctcaacagtcggatgcggttgaactaaaagagttatttcaaaatacagttatcgtgataaatagacgcgattactcgcaggtagaagttgaggattgggcatcctgcggagatgacctttctaacattgaagagatgataaagacccactattttattgtagctgttaatcaacagtcacaaatcgttggtttttcatctattacgcctcatggctatttacattctatgtttgttcacaaggactttcaaggtaaaggtattgctacgatgcttttggaagaaatagaacggtatgcaattacaaccgggattatgcggattacatccgaagtgagtttgactgctcgccctttctttgaaaaaaaaggttatgtagtagaggaagagcaaaagcgcaaggcgaatcagctttctcttactaatttttggatggcaagggaagtaactaaaatccaacgttatgagggacgtattcctgcctgcggtgtgttctgcgggggatgtcctacgtatacaagagagaaaaatccctgtaaaggagccgaactgaatagttctcgctgtgaaaaatgcaaaacatttcatttatgttgtttggagaaagagataacacattgtttccaatgcagcagcttcccatgtgccagatttaaaggctttactaagcgttggttgaagtatggacagaattttattgaaaatcagaaactgttaagtgagataggcgaagtagcgtttttggagtattataataaaaaggttacagattaagtttagtacgttcctttgtctatatatccaaaacggactaaacttatttgtactgacagcactatttttgtacttttgtcgcatataataaatcgcaaatggatataaatcagagttatagagaagcagtaaagaccataaaagaagctatcctacgcagccagtaccgtgcagccgtatcggtgaacaaggaacagctatctctttattacggcatcggacgttatgtgtcggaaaattctcgtacaggcttttgggggaagggtgcaattgaacaaatatcttctttgttgcagaaagaattgccggggctaaggggattttcagcaacaagcataagaaatatgcgtattttttatgaggagtgggataaggttttaaatcatccgccgttggctgatgatttggtgttgaatgaaaaattgcttcttgtagaaattcatcagccactggctgatgaatttaactggtcagacttcctttcaatcggctttagtcatcataccgaaataatatccaaagctaagactttggaagcaaggctattttatatacatgagtgcgctactcgttattggagtaaatacactttaagggattacttaaaagcagacctatacagccatcggggaactttgcctaataatttcgcacaaacattgcctgatactaagcaagctctaaaagctgtttgttcattcaaagatgaatacctgcttgatttcattaatgtggaggaactggatgaacaagaagaggatttagatgaaaagatagtagaaaaggcgattgttgccaacgtgaagaagttcatcatgacctttgggcaagatttcagttttataggcaatcaatatcgtatggaggttgcaggggaagaaatgttcattgatttgctctttttcaatcgagagcttaattccctggtcgcggtcgagttgaaatccggaaaattccgtacatcttatttggggcagttgaatacttatttatccgctttagatacatatatcagaaagccgcacgagaatccctctatagggataattctttgcagggaaatgaatcaaacctttgtagagtttgccgttcgtgattataacaagccgatgggagttgctacttatcgtgcatctaaagatatgccggaacgacttcgtaacgctctgcccgacattgaggacttgaaaaagctattgtaaggcaaaagccttatttcttttttggcaggtaattgccttttgttacctttgcataagaagcccaccacaaagcgaatttcttcgttttttttgttactattttgttacccactgttagtaataggtgggcttcttttctgataatcaattatatatgctaatcaatatataatatgtggcagaatataatcaatagttatcagctgtggaagaaaaggaaaaatgagacggaataactgctgagtattttacatcttatttgctttatggacatagagggcggttgcaacaattatcagtacaaatgccataatgaggaatattatccggataaggcgatgttttgaaaataggttggccatgcaggcagaagccacactgaaacgggctattatagaatcaattgtggcgttttcgaaaaagactgatgcaatactccatagtgcaataatggttaatatagcattggctgataaacaaagaattttatcaagtggcattctaaatacttttcttgttctcatatataggactctatgtttaactcctttcattcctgcctttcgctgaatcagccaaaggatagggcaaaaataaaagagaacttcctgacagaatcaatattgtcttggaatattgttaaatgattgaatttctaaacctatgtttattctttgctgtcaaaactctgtttgtgtctgatgcggctcatgtgaatagaggttattttcaagtaagacgcaatttcttttaggggtaccatttgtaggatttctggacattttttaagaagttggagatagcgttcttccgatgtaaatctgaacaaatccaagtaacgtgaatacgactgaaaaaataattgttcggctgcaatgcgggctattcgttgattttctttgttctcttcaaattcttgtagaagtaattcggaagaacagatgtagattctacatggggttattgcttgtatattcaattcagattttatgtcgtataaacaattgggataatcagagataaattcattggcaaaagaaaaacctacattatatgttttgttttcagtttggttgatgcaggtatatttgattacaccggatacaataaacccgaagaaagaaccgacttctccctctcggaggataaattcatttcttttatgataccgtagttctccgtttcttaaacacagttccctaaaaaagtcagtgtctatattgcccatgtatgaattaaaatctgtcatttacaacacatgtttttcgaaaggtacaaaattattattttattcctgattttttgtcattgttggtaagttggttgtggattctcttattataatactttaaaaatttaacttcacctacgttttttaaaagcttttggttttcaatgaagttttgtccgtattttagccaacgtttggtaaatcttttgaatttagtacatgggaaatcagaacactggaaacaatgtgttattcttttttccaagcaacataaatggaatgttttacatttttcacagcgagaaccattctgttctgctcctttgcagggacttttttctcttgtgtatatgggacaaccaccacaaaagacaccacaagcaggaatacgtccgttatacgatttcattcagccagccttttcgccatccaaaaattggtgagataaagttggttggctttgcgtttctgttccacttctactatatagcctcttttctcaaagaatggacgggctgtcaggcttacttctgatgtaattcgcatgattcctcttgcggttgcataccgttctatctcatttagaagtatggtagcaatgcctttaccttgaaaatctttatgaataaacatagaatgcaaatatccttggtgggtaatggatgaaaagccgacaatctgtgactgttgattggttgccacaataaaataatgtgtcttaatcatgtcttttatgtgggagaggtcgtttccgcacgatgcccaatctgccacttctgcttctgaatagtcacgtttgtttatatggaggactgtctcttgaaacaaactcataagttcaagggcatcagactgttgggcaattctaattgtaaaatctgtattcatgtttttaagtgctaaaatgtatgcttttagatgttccatgttctaacagaaagtctttcaatgtatttattgtgtttgcaaagataatcttttcatttctaatttattggttttggaaaccaagttgttgattctctgcttcgaatataaaaagtatgcgaattttttatgaagcatgggaatctgctttcaatcgccagccaatggctgatgaatttaaccgggtagatttcttgtcaatcggtttcagacctgcttataagaacaatttataacaaagtactcccaataaaagcaagactaaagcatatgctgcaagaatcgtctttgccctgaatagatgttctttatctgataattccttttcagtagtatttcttcggatttcttctattttctcaatggttacatcggctctctcaggacctttcctttctacaaggtatttgtagtgctcccgcatccgtcctctgctcaacttgcggagagcacggttctctttatccctttgtagcatgtcatttatgcagcctaatgttcccataagcagatttttatcatgtgtaagcaaaatggtttgcttgcacgtgtactaagatacggcatttatgtcgctttcgcaagcgattttgtgttttttgatataaactgatgtgacgatacgattttggtagttatgttaactcgttgtttgccagagagtcattttgccaacccattgccatgcttttggcaaacttttgccatgcctatggcaaagtcttgccaatagggtggcaaaatcttgccaacttgtcggcaagaaagacacacactgttccctatacctttattatagtgtgatagcgtgacaagtgtttttcctttttaaaacttttgtgtagaatgatgatgggcttcttttattctgttttgccggacggcatcagcagttcttcttcattgtagcgcggtcggtccttcacctcaatgtatattttgccgatgtattcgcctacaatccccagcgacacaagtatcacacctcctaccagccagacggaaatcatcagtgatgaccatccggggacggcgttatgctgtgtgtaagagtgaagtgtccatccggtgacacacagtgccacaagaataaagatgcagcctatccaaaaaatcatacggaccggtttgacggaaaaggaagtgataccgtcgatggcaaaattaagcatcttccggaaaggatactttgattctccggcaaaacgcttgtcacgattgtagtacacgctgtccgtctggtagccgatgaggggaaccagccctcgaagaaaaaggttgcgctcgcggaagcggcataggtgttgtatagcccgctggctcatcaggcggaagtcggcatggttgtagacggattttacccccattgccttcatcagccgataaaagaccaaagcggtgttgcgtttgaagaaagtgtcggtcttccgttctttacgtacgccataaacgatgtcattgcccgctttatagctgtttatcatgtccggaatcacctggatgtcatcttgcaagtctgcatcaatggagatggctatctcgcaacgctcttttactgcattgagtcctgctagcagggcattctggtgtcctacgtttcctgccaggttcagtccgcaggcataggccgtattttggtgcagttctttgatgatagcccatgtctggtcggtgcttccgtcgtttacatataatatatagctttccggggaaatttgccgggcttgtatcagccggtcgaataattggctcaatcgtttatgggtttcatgcagcactgcctcttctttgtagcaaggtacgacaacggcgagtatgggagagttttccatcatagaacaaatctttttgcaatattcgtaagaaatcgggagaaaaacaaattatcactcttttcttttgaaaacgaaacgtacgagtaagaagttgaccggaatggcgatggcgaaaaccggaatgggggccagaggtttggggatgcccatccagagagagaggttcagcaaccccatgtgtagcagatagctgcataagtgtgcccctccaaatccgaaggcttttctccatgagggcttccggccgaaggtaaagtaagcagtcagatagaaattggcgatgaagctgagagcatatcccagtgtataggctatgtttacattgataacccgttgtaatacaaaatacaatccgtagtgcagagctgtcgcaaagatgcccaccattacgaagcgtacaaattccggtagttgtttcagccgcttcatcttaacattaaatatctactctctgttgccattatcattggggcggcaaagttaggcattgtttcagaattatttgtaattttgctttgcgaaattaagctgcatctcagcaaattgcaaataaatttgcatctgctttcggtttgcgctatctttgcgtccagaaaacataaaaaacaaataaggtatgtcggacagaaagaaggcgttctggtttattgcgctgctgagtgtgcttgtggttgttccctttctgggagaaaccattttttattccaagggggaaccgcgggaggcgattgttgccctttctatgctggaaagtggaaactggatacttccggtgaactatggtactgatattgcttataaaccccctttcttctactggtcaatagccgccgtctcttccctttttggagaggtgacggagttttccgcccgtttcccgtctgcattggcttttttagccatgcagttgatgttctttgcctttgtggcaaaacgtaaaaacgttcaaacggcgtttctggcctctattcttcttttgtcttctttcgaggtgcatcgggcggctgtcgcttgtcgggtcgatatggttcaggttgcctttatcgttatttccctttgtctgctgttccgctgggatgagaagggatgccgcggagtgccctggcttgcggtgttgctgatgggatgtgccacgttgaccaaagggccggtaggctccatattcccttgcgcgtgtatcggtgtgtatcagttgttgcgcggacgttctttctggaaagcgtttttctcgttggtaggtatcggcttgctttcttttgttccttatttagcttgggtatacgtagcttacagacaaggtggacaaccgttcctcgatttggttctggaggagaataccgggcggtttatgggcaaaatgtcctacgagtcccatgaaaatcctatatggtataatttcctgactttgatttggggatggattccctggacgttggttctggtaatttccttgtttggcttgaagtggaaaaacatgcgttgtctgccggaaggggagaccctgctgttgcggttgaagaagggctggactgctttccgcaaccagtctccggtacaattgttcacgtggctggtcattctgataatctttgtcttctactgcatccccaagagtaagcggagcgtttatctgcttcccatctatccgtttatggcagtgctgatagctgagtatctgttggctttggtacaaaagggggcacgagttttcaggatttgtgcaatcatctttgcttctttgggcttgttgcttacgcttgtttttgtcgtagttcgtctcggcctggttcccgacagcgtttttggaagtggacgccatgccgctgagaatgtagcctttatgcatgcgttggaggatgtggctttgtctgttcccaagtggctcctggtagcgcttcccgtagtagccgctatctgcacattacgcatggtgataaagcgtgcggatagccggtcattattatatggcatagcaggatgtatgctctgccttttcgtatcattggattcggtttatcagcccacggtgctggctgtgaaatcagataaacatttggctgaaagggtcaatacgtatgttccggaaggtgtggtctattcttactcgaaaatgagtttctatggtgttaacttctatctgaaagaccgcatgcggcacattgaaaaggaacgtccgtccagcggggagggctatttgttggttcccgtaaaggaggaggagaatatgttgggacagctggaacagacgtatcatctggaaaagatattccgtacagacagacgcagttgtgatatgcgtaatgaaatctgcatgtataaatttagggcgattgacattcataacccataatttataactcataacttaaaatgaatccgatagatatcattaacaaatattatccggaagagaatgagttgcggcatatactgttgacgcacagccgttccgtagccgacaagtcgttatggattgccgaccgccatccggaactttcattggataaggattttctgtacgaggctgccatgctgcacgatataggcatttttcttacagatgcggcaggtatccattgttttggcgacaagccttatatctgtcacggttatttgggagccgacctgatacgcggcgaaggctatccccgccatgctttggtttgtgaacgccatacgggtgccggactttcattggagggaatcattgcgcaggatttgcccgtaccgcatcgtgaaatggttccggtcagcttggaagaacaagctatctgttttgccgataagttttattcaaaaactcatttggaaaaggagaaaagtgtagaaaaagcccgaaaaagtttggaacgttatggtgaagaaggggtacggcgctttgataattggtgcgaacagttcttgtagcaatctaaatttctttaaaaagggagattatccgtataaattatgtacttttgcccctccaagcgtaaactattagttaatgacgccattgaaagcaaatacattcatatcattcatactactattcgtcttgcttcttctctccggtggggctgcttctcagcgccgtagagcgaaggtcgcgcctccgaatattcagcggacagacacgttgcaggtaggggatagtttgcagatgggagactccctgcaagggggaaaggggcttcctgccgattcgttgcaacaagatacggtagcggctgcgcctcccaagaaggatgcattggatgctcccgtagcctacgaagccaatgactccattgtatttacgcagagtggctttgcccatctttacggccagggaaaggtgagttatccgggtgctgacctggaggctgatgtcatctctatggatatggacaacagtacggtttttgcccgtggcgtggtcgattctgtaggaacagccaagggaagaccggtcttcaaagacggggacacctcctacgaaaccgatactatccgttataacttcaagagtaaaagaggtcttattagcaatgttgtcagccagcagggcgagggatacgtgaccggtaataatgccaagaaagggaataatgatgaactctatatgaggagcggtcgttacacgacttgtgaccatcatgaccacccccatttttatatgcagatgacttatgccaaggtacgtccgaaaaagaacgtggtgacgggacctgcctatctggtagtagaggatgtgccgcttccgcttgccgttccatttttctttttcccgttttctagcagttaccagtccggttttctgatgcctacctatatggatgactccaatcgtggcttcggtctgacggacggtggatattacttcgccatcagtgaccaaatggacttgaagctgcgggcggatatcttcacgaaaggttcttgggcgctgaatatggagtcgaactatgtgaagcgttacaaatattccggtttgctgcaggcaagctatcaggtgaccaagaccggtgacaaaggcttgcccgactactcggttgccaaagacttcaaggtggtgtggtctcaccggcaggacccgaaagcgagtccgaattctaccttttctgccagtgtgaactttgctaccagtagttatgagcgtaccaatatcggcaatatgtacaactcccaggcaatgtcgcagaataccaagacttccagtgtcagctattcgcgtaactttcccgaccagcatctgagcatctccgcttcaggtaatattgcccagaccatgtgcgactcctctatcgcggtgactttaccggacatgaccatttccttgagtaccattttccctttcaagcgcaaacatgcagtgggagatgaaaagtggtatgagaagatttccgttcgctatactggccgtgtgaagaacagcatcaagacgaaggacaatctgttgttcaagaagaacctgatacgcgattgggagaacggtatgcagcatgagattccggtaagtgccacgtttactttgttcaagtacttcaatgtgacgcctaccgtaaactatacggagcgttggtacacccgcaaggtgaagaaggactgggacgatgagcaaggcaaggaggtgaatgatacgacctacggctttcaccgtgtatacgactacagtgccagtctgggtatcaataccaaagtttatggtatgtacaagccattgttcatgaagaagaaggagatacagatacgtcacgtcatcactccctccatcagtttcagcgctgcgcccgatttcacttcgtcccgttttggctattatgactcttatataaaagaccagaacggcattcgcgataccgtgcagtattcctattatgccggtcaggtgttcagtccgccaagtggaggaaagcaggggcttatcagtttcaatatctccaataaccttgaaatgaagttcaaggataagaatgactctatccgcaaggtgagcctgattgacgatttgagtatgggtatcagttacaacacggctgcccaggtgcgtccttggagtgacttgagctttaatctccgtctgaagttgagcaagagttatacgttgagtatgagctctacctttgccacttatgcttacgagtttgatgagaacggaagggtggtgcccggtaaccgtacggaatggtcgtatggccgtttcggtcgttggtcgggatatggtacgtcgttcagttggaccgtgaacaatgattcgtggaagaaaataaggaacttcttcaccggtcagaaggatgacgaggagcagggccaagaccagaatgcctcgacggaggaagacggtgacatggagggggaaactaccgaggacggcactccgaagaagaagaaggaaaaggctgctgccgatgctgacggctatcaggtattcaagatgccttggtctatcaacttcagtaccggtttcaatattacggaagacaccagtaagcccattaatcgtaagaacatgcgctatccgtacaaattcagcctgaattcccttaatataaacggtaacgtcaagcttaccaataaatgggctgtcagcttcaattccggttatgacttcaatgcgaaggagataacgcagaccgctttcaacatcacacgtgacctgcactgtttcagcatgacggctgccatatcacctttcggacgctggaaatactataactttaccatccgtgccaatgcaagtatcctgcaagacttgaaatgggaacagagaagccagactcagagtaatattcagtggtattgatgtttaccaaattatttccgtctctccatgttcccgcaaatactcgtttgttttgctgaaatgcttgttcccgaagaagccgttataagcggataggggagatggatgtgccgaggtaagtaccagatgtcggctacggtcgatgaatgcccctttacgttgggcgtaggctccccaaagaataaatacaagatgctctttttcttcggcgagaatgcggatagccgcatctgtaaatgtttcccaacctcggttttggtgagaaccggcttggtgtgcacgtacggtgagggtagcattgagcagcaatatgccttgctctgcccagcgtgtcagattgccggtagtgggggcatcagtgccaatgtcattttttatttccttgaaaatattaagtaaggaaggagggaaaggaacaccgtcatttacggagaaacaaagtccgtgtgcttgtcccggaccatgataggggtcttgaccgattatcacgacttttactttgtcaaaagggcataggttgaatgcattgaatatcagctttcccggaggatatattgcatatttcccatattcgtcccgtacaaaatcagtcaatgtacggaaataatctttctcaaattcaggttgcagatgtgctttccagctttcttctatttgaacattcataattggatctgttagtagtttcggatgctaaagtacaaaataaaaaataaagtccaaccttttgagggggtgaactttatattatatgacgggataaatgtatatcaaatcaggtgtatattgtgttccttgcactctttgcgcatatcttccggccagatactggcttgtatctcaccgatatgcgccttgcgcagatagaacatacagaggcgggactgccctataccgccaccgatggaaagcggcagtgtatcattcatcaagcgtttgtggaagtaaagttccaggcgttcctcttcgccttcctctttgagctggcgaagcagggcttccttgtctacgcggatacccatggaggaaagttcgatgctgcgttgcaggatgtggtcccatagcaggaggtcaccgttcagtccggggaggtcgttcagccctttgctggtatagtcgtcgtagtccggggcgcgtccgtcgtgcttcttgccgtcgctcagcttgcatccgataccgatgatgaacactgcaccgtatttcttgcaaatggcatgttcgcggcatttgggttccaagtccggatacagttggcgcaattcttcggcatggataaagtgaagtttctggggcaggcaaggcttgatttgcggatacatctcatataccatatattctgtgcgcaccatagctgcatagatacgggttactatctccttgaggaattccacattgcggtcttcggcagtaatgacgcgttcccagtcccactggtctacataaagggaatgcagattgcccagttcttcatcggcacggatggcattcatgtctgtgtagatgccatatcccggttcgatatggtattcggcaagcgtgaggcgtttccatttggcgagggagtgcaccacttcagctttggcgtcgcccaaatctttgatagggaaagttacggcacgttccactccattgaggtcgtcattgatacccattcctttcaatacgaacagtggagctgtcacacgtcgcaggcgcagttcggaagagaggttcaattggaagaactctttaatttgtttaatccctaattcagtctgttttaggtccaataaaggtttgtaaccttcaggtgttatcaggtagctcataaatttattcagtataacttctgttaaattgctcggcaaagataggaataatattgatacttgcttctgttttgtgggaaaaaagaacaaaatgtttgtgtaattgcggttagtcttctcaaagtaataataaaaatattcctcggtttgatataaaaagcgtttgaatgttaggaatctgctaatttttttatacttttgcatccacatttggctccgtagcttagtgaatagagcgtcagattccggttctgaaggtcgtgcgtttgaatcgcaccggggtcacaaagaaaggaactccctttgcatgaatactttgcaaagggagtttctttttatacaatacatccagaaaagtcaaccatacggttctctttcttgttataatttccatagagttagaggtatgaaacaaataatatttatttttgcaatgttaatgacttgtctgtcctatgccggtaagccggaaggacggtcagaaaggagaacagacatgaaaccaatgaaagagatttatctggcaggaggatgtttttggggtaccgaacatttcctgaaacaaatagaaggtgtggaggctacccaggtgggatatgccaatggaaatatagccaatcctacctatcagcaggtatgtaccggtaccacggactttgccgaaaccgtaaaagtacagtatgatcccgatgaggtggacttgcctttccttatcgacctttatttcaaaacgattgaccctaccagcctcaataagcaaggggggggatagaggtacacagtatcgcacgggtatctattatacggataccgccgacctgcccgttattcgtgaaaccgttgaccggctggctgccaactactcccgtccgttggttgtagagatagagcctttgaagaacttctatctcgccgaagattatcatcaagactatctggacaaaaatcctggtggatattgccacattaaccccaccttgttcgacctggcacgtaaagcgaagatgaagaaagaaggagatggcgagtatttaaacctggaaaagtaacggacaatggatatactgttaataagtaatgaagatacgtgccgcagccgtatcgcgcaggaactcctgcatgcatttggcaggggaatgaatatctctacggcaggaattatggaggggaactgcgttcccgatgccgtgtgcaatgtgatggaacagaatggtttcagcgtgtctcgcaagaaaccgtctggtgtcgggacctatacgcaccggtcgtgggactacgtgattaccctatgtaaagaagccggagaagaactgaaatttatcactctggatgccaagcagcaggtgcattttaattttgaagacccctttaaaaatcgttttcaaaatgaaagtgagcaggagcaacaaattgccgcactctatgaaaccatgtaccggcggctgtatgaattttaccgcgatgaactgagtgggcagttgttaccccattgtacgtgcggtgcaaacacctattgccgttgtgaatagtgaaatatgtgttttttttgaagcaatctcttgactcgtccctaagggcaggacctatctttgcatcataaacaaaatgtgcatgagtttatgaagaataaaatgaagtttaaaatcggagagttttccaaactttgccaggtgaccgttaagacgcttcgtcattatgaagagataggattgatgatacccgttgaagtggatgagtggacggggtatcgctattacgacatcagccagctccggtgtatgagccgtattgtttacctcaagcaattagggttcagcctcgaagagatatccgagttgtttgccgatggcaaggaatttccggatgctgaattgttgaaggttaaaatagaacgttgcaaaaacgagattgaacacttgatatggcggcagaccgaacttgccaaattggaaaatttactccataaacaagagaatgttatggaaaaagtgtttaagaaatccctcccttcaagaatttttgctacccatcgccgtaaaatagactcttatcaggagctgttcaatctttgtccgaatatcatcgggcctgaaatgtaccgtttgggttgtgaatgtcctgccccggaatattgtttcacggtggaatataatgaggaatatggggttgatattgatatcgagttttttgaagcggtggctgaacgcaaggaagattcggaactgattaaattcaaggaacttccggaagtgccggttgcgctctgtgtcaaccattacggtgcttatgagcatatgcccgaaactttcgccgagctttttgcgtatgccgagacaaatggatacgaggtcattgaccgtgcccggttttgccatattgacggcatttggaacaaagaaacggtggatgaatggatgacggaaattcagttgcccatcaaactttcttaatcagcctttgatttctgcggaaagctttcaaccgtgagaatacctaaaaatagggataggtagtcaacttattttctgcgaactttgcagactgaaaaaagaattgaaatgagaagcctgcatattctgttcatattggtagttgtcacttggctcggttttccgctgagagcgcaagaagctatttctatcgggactcgccacactttgttttcgcatgtcttgaatgaggctagagaatattgggtgtatgtacctgcaacccgcccgggtgaaaaagaggaaagttatccggttctttatttgctggacggtgattctttttttcattcggtggtaggttttactcgcttgttttccacctccaaagtttcttccttaccgccctgtatcgttgtggctgtcctgaatacaaacagaaccagagactttacgccaacctgttccgctgcccggcgtgacggaactgtccgtccgggcgataaaccggaagggggtggggcaggacaattttgccgttttctgacggaggagctacgcctcgcagtggaacaagacttgccggtgaatggacaacacttgttggctggacattcttatgccgggttgttcacgctgcatgttttgctgaattatcccagtgcatttgatacatacatcgccatagaccccagtttatggtgggataaaggatattttcagaaacaggtagaacggcaggtagataaggttaacttttcaggaaagcaactgtatgttgcgtttgccactcagccgcgtcttgataggaagctgatccactttcccctgacagatgattttatagggagtgcagttcctcgtatggagaagcggcatttgcgggtggtatcaaaaaagttcccggaagagacgcatggaacggttgctcttccgggattttatgacggactgaaaacgttgttcttccgttctgcggttggaatttctctgccgaacgaacctctctgaaaaaaaatctatttttcagtaagctgaatgatatgcgccattgtactaaggggactacctataccatggtgaggtctgccaaaatcctaaaagcgtcatagcctgagtcgccttccggcaggaagcgccgagaagcgccgtttccttataaatcagtattttcagctccggagaaggttgagtgtccttctccggacacactgattaaaaaactgcaaaagtgcagccggggcttcgttgactccgggcaattggaatagtagtacaactactgttgtacaatgagcgcagcaccatatgccctgctaccgtacggaagtgcataaaaaaacagttgcctggagaaaccctctccaagcaactgttttcagcttcttgatacttaactttataatctacatattctaaatctttcttgtcatcaatcgtcaatgtcaatcaccctcattttagagtcaaatgtaatttcccaacgattagacaactttatctcatactcattgtcatcgtactcaatctgaagaattcttgcatccggataattggtctttacatagttacgtatcgcttccggtacaatctgtgcaggaacttcactttgtctgcatcgtacctccttccattctcccgatttatcaaattctaccttctccccattcgtgaacaccacatcatagcttttataaaacattcccgactccaatttagccattgccaccttatggtctttaaaataagtcttgataaatgtctgcgccttcgccggcaactggctcacctctatcggcttatcattatctgccattaccattgtgtgcactgcaaacatacaaaccaacatcataactaactttttcatacttttctatttttaataattaatactttatttgttttctgtattgcaaagatgggaaggaaatctggaaagaattgggaaaaaaactctatttttggaaatgaaaaaaaatctatttttgaaaatgggtgttgcggctcttcacctatgaatttttgtttgcaatgaatattatttaaagacacaatagactattatggctatgaaaatattaaatcagtttatcgatgattttgtaggtgttttccaatatcggtttatggatacctttcaatattttaaagaaaggaagaaaagtaaatatttgggagatagatttgaggaatgggttgtgaagaactctaatattagtaaagagggttatccggatctatgtgataagaaaatattttggcggcttttagattggagaggtgataaatacattgagggttataggcctctgtcttcatcatctccggatttgttgatggagtgtgttaccactacgagtaccattcatgaagttggagatattatagctgtagaatgtaaatggcgaagtaagataggtttttatctcgatataaaagacattgaaaagtacgaggggtatatgaattccaatctgttgaaccgtccgataaaaaacttgttttatgtttttggctttggatggtgtggtgacagtccggaatctgtttatgtagttcctgccagagaattgtatgattatgataaagatacctgtagaataacgttccctattaaagaaaccgagaaggagaaaatggatagattggagcgctttaagaagaaagacaatagatgccttctgtacataaagtgatgatatttagagcgatacggcagcatgctagatattgattaaactataaaaatcagtaaagtactactgtataccgataaagtatgcagtagtactttgttatataaactcgaatcaactgttattgtttgggtcgccgtcaatctttgtggcgaaggctattactggcatctaatgcggtttgcaacctttcccagtcgtcacaaagcgcctgcatggacggaaacaataaatctgctccggcatccagtaatacctgcctgtccagcggaccggtattgactgccacagtgaatatgccggctgctgttccggcttgtactccgataggtgcattttctacaactatagcttcgttggcttgtactccggctttttccagtcccattagataaggctcaggatgaggctttccgtatttcacatcaaaggcggtcaccatgtggtcgcgctgaaacataccagggaagttgtgggcaaggcggttcagcagggagtgttggcccgaaccggtgacaagtaccggaataagtcctgccgcttttaccttttgcagcacttcccaagcacccggcatacgttccggttccgggtgggtactgaattcggcgcttttctctgcatagatgctttctatcatctcgggagtggcatccttgccatactggcgttgataaacgatgttgatggtggaggctccggtacgtccctcgtgcatgtatgcctcttcacggctcaagtgcaggccatgacgttccattactttatgccaggcatcggcatggtagggcatggagttgaataacacaccgtccatgtcaaaaagaacggctttcagttggatgtaggggtgcccgtgcttttccagataacgggcgatagagttttcgaacacttggtagattggggattgagaatttaaaaatgcggggtagataaatagagagttgagaatcggggaacggttctcttcgcacttgttgtgcagccatttctcaattctcaactctcaattcttaatttatcaaagtcttgcctggatagctttggactcttcttcgtagccgggcttgttcagcaatgcaaacatattcttcttatatgcttccacacccggttggttgaacggattgactcccaaaatataaccgctgataccgcaagctatttcgaagaagtagagcagacctccgatgctttcttcattcagtgcagggataacgatgcgcatgttgggtacgccgccgtcaacgtgggcaagctgtgtgcccaattcagccatcttgttcacttcgtccacgtgcttgcctgccaggaagttcagtccgtcgaggttggcttcgtccgaaggtacttgcagggagtgctgtgtcttctccacggagatgacagtttcgtagatggtacgttcgccttcctgaatccattgtcccatggagtgcaggtcggtggagaaatctacggcagcagggaagatacccttgttttccttaccttcggattcaccataaagctgcttccaccattcgcttacgtagtgcagtttgggattgtagtttacgaggatttcaattttcttaccgttcttgtagagctcgttacgcgtagctgcatagatggcagcaggattttctgcaaacggaacatcttttccacaagccttttccatggcaactgcacctgcaaccagtttctcaatgtcgaaacctgctattgcgatgggcagcaagcctaccggagtcagtacggagaaacgtccgcccacgttatcggggatgatgaaggatttgtagccttcgttgtcggccgttacgcgggcagcgccctttttggcatcggtgatggcaacgataaccttctttgccatatccttgccgcgttggtcttcgcattgctttttcaacagacggaacgccaaggccgtttcagtggtagtaccggatttggagatgttgataacaccgaatttcttgtctttcaagtattcggtgagttcatatagataatcttcaccgatattgtgtcctgcatacagaatgaccggagccgttttcttgtcttgcaaccaagtgaagctgtttgacaaagcctctatcaccgcacgtgcaccgaggtaacttccgccaataccggcaactactactacctcgcagttgtcacgcaacgtctgtgcggtagcctttaggtcggccaggtgctctttagtgatggaagaggggaggtgcagccagcctaagaagtcgttgcccttaccggtaccattctctaatgcttcctgtgcagcctttacttgggcttcataggcgaaaacgttttctttggagatgaatccaagagtcttttcaatgttcaaactaatcataatattctaggttttaaattcagtatttcgttttatcttttttcgcgcttaccggaatgaatcggtaagcagcttgatttcaatcgtcggcgagatacgctcatacagaatgttgtatactgcatctacaataggcatgttgacatgataatgcttgttgatttccttgatacattttgtaccgtaatatccttcagcaatcatttccatctcaatctgcgcgcttttcacggagtatcccttgccaatcatcgtaccgaatgtgcggttgcggctgaaattggaatatcccgtcaccagcaggtcacctaaataaacggaatcacttacgtttctgttcagcggatgtaccgtttgcaggaatctgttcatttcctgtatggcattggacatgagcacagcctgaaagttgtcgccatatttcagaccgctgcagataccggctgcaatggcatatacattcttcagcaccgaactgtattcaatgccggcaacgtcattactgacagaggtcttgatgaatgaactggccagtttgcgggcaatggtgcaagccttgtcggtgtcgggacaagcaatggtcaaataagaaaggcgttccagagccacttcttccgcatggcagggacctgccaatacagcaatattctcagccgggacgccatattccttagtgaaatattccgagacaatcaagttgtcatcgggcacaatacctttaatggcagtgatgatgaatttatccttaatcttagtcttcagtttcttcaagtgaaccttcagataaggggaaggtgtaacgaagatgagcgtatcagattctttcacgacatcattgatgttggagttgaagttgatacgcttggtatcaaacttgacgcccgtcaagtaggcagggttatgaccaagccgtttgaagtcggcaatacggtcatcgcgtcgcatgtaccaatttatagactccgcttgggccagaaccatttttgcaatggcagttgcccaacttcctccgcccatgatggctatcttaccgggtagtttcatatcgaaattaataattaaaaattaaaaattaaaagaggggaaaggagtaccttcctcctcctcttatctttaatcttgcctatttaattctttaatttttaattcttaattcttccgacccagtcagcaacttcgtttacggtcgggtttgccagttccaatttatatttcttgttgataccgcagatgtccatgtggagtttttgcggattcacatctttcatgtcactcaccaggttgtagccggctttctggattacagccacccagtcttcggggatgcccagctctgtgtatcgtgcaggagcatctttggggataaccttttccggacgcatctgcgggaagaaaagcacttcttggataaaggattcgcccgtcattaacatggtcagacggtcgatgccgataccgatgcccgatgtgggaggcataccgtattgcaatgctttcaggaagtcctggtcgatgaacatcgcttcgtcgtctcccttttcgctcaagcggagttggtctttgaagcgttcttcctggtctatcgggtcgttcagctcgctgtaagcgttggcaagttccttgccgttcaccatcagctcgaagcgttcggtcagtcccggcttgctgcggtgcatcttggtcagcgggctcatctctacgggataatcggtgatgaaagtgggctgtatgaaagtaccttcgcagaattctccgaagatttcatcaatcagcttgcccttgcccatggtgtcgtcaatttccatattcagttccttgcacacctggcggatttcgtcctcgctcttgccttcgaggtcgtatccggtcttttccttgatggcttccaggatgggcagacggcggtagggagctttgaagctaatggtcttgccgtctatctcggtttctgtgcagccgtttacggcgatacagatgcgttccagcaatttctccgtaaaactcatcatccagttgtagtccttgtactgcacgtacagctccatacaagtgaattccgggttatggttcttgtccataccctcgttacggaagttcttgcctatttcatatacaccttcgaatccgcccacaatcagtcgcttcaagtaaagctcggtggcgatacgcaggtagaggtctatatccagagagttatggtgggtgatgaacggacgggcgcttgctccaccggggatggattgaagaatcggcgtctccacttccgtgtagccggcttcatccagcacagcacgcatggtcttgatgacggtggcgcgcttcaggaatttttctttcacgccgtcgttcacgataaggtctacataacgctggcggtagcggagttcggggtcttcgaaagagtcgtaagccacgccgtccttatatttcacgataggcaggggcttgatactctttgcaagtacggtcagcttcttggcatggatgctgatttcgcccatttgggtacggaatacgaatccttcgataccgatgaagtcgcctaaatcgagcaaacgtttgaacacggtgttgtacatctccttgtcctcgtccgggcagatgtcatcgcgggtgatatatacctggatgcgtcctttggagtcctgcaattcgatgaaagatgctttacccatgatacggcggctcatgatacgtccggcaacggacacttggcgaggctctgcatcgtcgttgaattcagctttaatatcggtagagaaagcatttgttacatactctgctgcgggataaggctcaatgcccatcgcgcgaagttcattcatgctgttgcgacgaatgatttcttgttcacttagttctaatacgttcatttcgctatatttcactcaatttgggtacaaaagtacgaaacatttttcagatagcgaacctttttccttgaaatataaggaacggggagtgacattaatcctctccttcggtatctacccattcgatatgcggggagaggagggtgcgttccgtcacttgtccgcattgcccgcggtagtattcggggatgaggcgtatctgcaccgcagtgatttgcgtcggactcacttcttctggggtgtctaccccggtgccttccgaacggcaggtgtagtagaacgtcccgatgccctttagctttacggagtgtcccgagctcatcagcttgcccagcacttcaccaaggttcattaatactgcataagtatctcccggggttaccgtagacatttccgacaataatcgggctatttcatccgttgtatagggatgtcctttggtgacggctcttgggtgccatttgtcgtcgcctttctgttttactttcttatagaatgccatgggggcttgttgttattatgtgtccggctcaaccggtaggtcaggcatggttcatacggtatgaatgtgccaatcatacggtatgattatatcaatcatacggtatgattatggtaatcatatcttatgatttatcattgaatcgcaaagatagcataaatcatccgcatagtgtgcaggtttaaggtgttttttctgctgttctgttttaaaaaaagagtacctttgcacccgctaaaaagaaatagatatataatatggcaggacaaaagactccctcggcgttggggacggaaagtataggtaaactcttgatgcaatatgccgttccggcaatcatcgcaatgacggcatcctctttatataatatggtagacagtatcttcatcggtcacggcgttgggacgatggctatttcgggattggcgttgactttcccgttgatgaatctggctgcggcgttcggctcgctggtgggtgtgggagcctctacactgatttccgtcaagctggggcagagggattatgacacggcacagcgtgtgctgggcaatgtctttgtgctgaacatggtgctgggagtggcctttaccatcattgtcatgctctttctcgacccgattctctatttcttcggaggcagtgaccagacggtgggctacgccagggattatatgcagattatccttttgggaaatgccgttacgcacctctatctggggctgaatgcagtgctacgctcttcagggcatccgcagaaggcgatgtatgccaccatagccacggtggttatcaataccatactcgacccggtgtttatctatggtttcggctggggcatacgtggcgctgccgtcgctaccattgtggcgcaagtcatctctttgacgtggcagttcaagcttttcagcaataaggacgagctgttgcatttccaccgggggatattccgtctgaaacgtaagattgtattcgattcgcttgctatcggcatgtctcctttcctgatgaacctggcagcctgcttcatcgttatcattatcaatcaggggttgaagaagtatggcggcgacttggctatcggggctttcggcatcgtgaaccgtctggttttcattgtagtgatgattgtgatggggctgaatcagggaatgcagcctattgccggatataactttggggcgaagctgtacggacgggtgaacaaggtgctgagactgacgataatctatgccacggcagtgaccactttcggctttctggtcggtatgctggtgccggacctggtggtgggcatctttacatcggatgcggaactgacagagctttcggtcacgggactgcgtattacggtaatgttcttcccgattattggtttccagatggtgacttccaactttttccagagcataggcatggcaggcaaagcgatattcctttccctcacccggcagatgctgatcctgcttccttgcctgcttgtcctgccgcagtttttcggagtggcaggagtgtggtacagcatgccggtatccgatttgcttgcaagtttgatagcattggtgatgttggtttgtcaattccgcaaattcagaacctctcccttgtagggatgggtcgggggagaggctttgaatttttcttcctactttctgcagatattccgtaagaatatttatatttgctatctgcaaaccaatagatgaacaagcgtatgggcaataattttataatcaatataggccgtcaactgggcagtggcggacgggagataggcgagaaactggctgcccgtctgggtattgacttttatgataaggaactgattaggttggcttctgaagagagtggactgtgttgtgagttttttgagaaagctgatgagaaagcttcacaaggtattattggagggctcttcggcatgcgtttcccttttgtcagtgacggggctatcccagccacgaattgcttgagtaatgatgctctgttcaaagtgcagagtgacgtgatacgcagattggcagaggagaagtcctgcttgtttgtggggcgttgtgccgattacatcctgcgagaacatccacgctgtgtcaatgtcttcatttcctgctccaatgaggagcgcatcaagcgtatttgccgaatgtattccatttctgagcgtgaagcggaggagatgatgaacaaagcggacaagaagcgtgccgaatactataactactacagctacaaaaaatggggagctgccgaaacataccacttgtgtatcgattcttccgtattgggtattgaagctacggtggactttatagaagagttcgtcaagaagaagctgaaactttaaggaattaaaattaaaggctgcgcaatgttggtttaacccaactatgcagcctttaattttaattccttaattcctcctacatcattgtcagcaatatcatctgtcccgccagaatacgcaggaacattgtcaatggatataccgtggagtaacctactgccggagcatcattgcctgatgtctgattggcgtatgccaatgcgggagggtctgtgttgctacctgctatcaaacccatcagggtgaagtagttcactttgcagtagaaacgggctatcataccgattatcaacaaggggataacagttatcaggaatccatagcctacatacagtaatccgctaccttctactactgtttgtacaaaatgctcaccagcttctataccgacactggcaaggaagagcacgataccgatttcacgcaacatcaagttggcactcatggtggtgtacgtcacaagatgcattttgtgaccgaaacgtccgatgaggatggcaactaccagcggaccaccagcaagacctaacttaaccggtgtcggcatacccgggaatgcaatagggaggcttcccagcaggattcccaaaaagattcccacaaaaatagttacgatattcggagtgtccaaacgtttcaactgattacccaatacgccggctacacgttctacggcatcctgctggcctaccaccattacacggtcacctacctgaagtaccagattgggatcggcaaacaagtccatacccgaacggttgatacgggttacatttacaccgtacatgctgcggaagtggaggcttcccagcttcttgccattgatttcagatttagtgacgaggatacggcgggaaaccatcggagtgtcctgtttttcccagtctacgtgtatttcttttccgataaaggcggttaccgcttcggcatcttcttcggaacatacgatgaagagctggtctcctacgtggaatattgtttcatgattggggatactgacgtgcccctcgtggcgtatgcgcgaacatacaaacgggcgtcccagaaaatcctttatctggagcagggtctttccggaaattgattcattgcgtacctcgaggtgaagcatgtgcggctgatgctttacatctgcttcctgcgtattgagttcctgttcctctttcttgaggttcacccggcagatataacggatggctatgatggaacctatgatacctaccacaccaagcggataggcgcaggcatatcccaatgcgatggggtctcccgtatagtttatctggttcagggcttcttgtgcggcacccagacccggagtgttggttacggcaccatagagaatacctactatcattggcaagtctatccctccgtcaatgaagtagatgctcaatgctactgcgatattcagcaacacgataccgacagcaagcatgttcagccgcattccccctttcttaaaggaagagaagaaggagggcccgacttgcagaccgatacagaatacaaataaaatcaaaccgaattcgcggatgaaatgcaaaatgtgtgtttcgcccgtgaagccaaaatgccccatcaggatacccgcaaagaggacgaatgtgacccccaacgataccccgaaaatcttaatcttacccagcaatacgcccacagatattacgaatgcatacaaacaaacgatgtgagcgacagatgaagggtcccataacaagctttctaaccaattcatactaccttttaatatgtcgtttttttaaatttcgcgcaaaattacttaataaaaaggaggtggcaaaggctttgtggtactttttgctatatcaactttgcaaaagtagagtatgcttccggtgaatacactgaatccgtatggatgcggagtcatctgtaagtgcaattttctctaaaaaaagattttgttctaagtatttccttatatttgcaagtctcttgatgacaaaaatgaatagtattcatctattttaattttaaataaactatggcagacagtaaagaaaaactcttctccgacttctctcccgtttccactgagcagtggatggagaaagttaccgcagacttgaaaggggcggatttcgagaagaagctcgtttggaagacaaacgaaggatttaaagtgaaacctttctaccgtatggaggacctggaaggtttgaagacgacagatgctcttcccggcgagttcccttatctcagaggtaccaagaaagataacaatgaatggcttgtgcgtcaggaaatcaaagtggaatgccccaaagaggccaatgccaaggcgttggatatcttgaataaaggtgtagattcactctctttccatgtaaaggccaaggagttgaacgcagagtatattgaaactttgttgaaagatatctgcgcagaatgtgttgagttgaatttctctacctgccaagggcatgtggtggaacttgcagaacttcttgtcgcttatttccagaaaaaggattatgacttgacgaagttgcagggttccatcaactatgactacttcaacaagatgctggccaaaggtaaagaaaaaggtgatatggtggcaacagccaaggcgctgctcgaggctaccgcttcccttccgaaataccgtgtgttgaatgtgaatgcgttgacattaaataatgcaggttcttatattttccaggagttgggttacgctttggcttggggtaatgaatatatgaatcagttggttgatgccggtctgccggctgcaatggtagccaagaagattaagtttaatttcggtatcagttccaactacttccttgaaatagccaaattccgcgctgcacgtatgctgtgggctaatattgtggcttcttacagtcctgagtgtctgcgcgactgcgaaaacaagggtaaggataacgagtgtcgctgtgcagccaagatgaagattcatgcggaaacttcttcattcaacctgactttgtttgatgcacacgtaaacttgttgcgtacgcagactgaggcgatgagtgccgcccttgccggtgttgactcaatgacggttactccgttcgacaagacttatgatgctcctaacgaattctctgagcgtatggcgcgtaaccaacaattgctgttgaaagaagaatcgcacttcgataaggttatagacccggctgcaggttcttactatatcgagaacttgaccgtctctattgccaaacaggcttgggacctcttcctcgctgtagaagaagacggtggtttctatgcttccgtgaaagccggaaaagtgcaggctgccgtaaacgagagtaacaaggcacgtcatgctgcagtcgccaagcgtaaggaagtgttgctgggtactaaccagttccccaacttcaatgaaaaggccggggataagaaaccggttgaggctacttgctgttgcggcggcggacatacgtgcgaaaaagatgttccgacactgaactttgaccgtgctgccagtgaatttgaagcgttgcgtctcgaaacagaggcttccggcaaacgtccgaaagcgtttatgctgactatcggtaatttggctatgcgtcaggcacgtgcacagtactcttgcaacttcctggcttgtgccggatatgaagttgtggacaacctcggtttccccactgtagaagaaggtatagaagctgcaatggctgccaaggcagacattgtggtattgtgctccagtgatgatgaatatgcagaatatgctgttcctgccttcaaggctctgaatggccgtgccatgtttatcgtagccggtgctcctgcttgcatggacgacttgaaggctgccggtatcgagaactttatccatgtccgtgtcaacgtattagagacattaaaagaattcaacgccaaacttttgaagtaagcaacttcaatcgtaaatcgtaaatcgtcaaatcgtaaataacatgatgcgaaaagattttaaaaacttagatatatatgccgcttttcagcccgtcaacggtgctgagtggcaaaaggctaacggcatccatgctgattggaaaacgccggaacacattgaggtgaagcctgtttatacaaaagaagaccttgagggaatggaacacttgggctatgctgccgggcttcctccttatctgcgtggtccgtactcggtgatgtatacgttgcgtccttggaccatccgccagtatgcaggcttttccacagcggaagaatcaaatgccttttaccgtcgtaatttggcttccggacagaaaggtttgtccgtagctttcgacttggccactcaccgcggctacgaccccgaccacgaacgtgtagtgggtgacgtaggtaaggcaggtgtgtctatctgttctttggagaacatgaaggtgctgttcgacggaatccctttgaacaagatgtccgtctccatgaccatgaacggtgccgtacttcccgttatggcattctacatcaacgcaggtctggagcagggtgccaagttggaagaaatggccggtactattcagaacgatatcttgaaggaattcatggtgcgtaatacctatatctacccgcctgcattctctatgaagattatctctgacatctttgaatatacttcccagaaaatgcctaagtttaactctatctccatctccggctaccatatgcaggaagcgggtgctacggcagacattgagttggcttacaccctggcagacggtttggaatatctgcgtgccggaacggctgcgggtattgacatcgatgctttcgcaccgcgtctctctttcttctgggccatcggaacgaaccactttatggaaattgccaaaatgcgtgccgcacgtatgttgtgggcaaagattgtgaagcagttcaacccgaagaatccgaagtcgctggctttgcgtacgcactcccagacttccggctggtcgctgacagagcaagacccgttcaacaatgtgggccgcacttgtatcgaggcgatggctgctgcattgggacatacccagtcactgcataccaatgctcttgacgaggctattgccttgccgacggatttctctgcacgtattgcacgtaatacgcagatttatattcaggaagaaacttacatttgcaagaatgtagacccatggggtggctcttattatgtggaaagtttgactaatgagttggctcacaaggcttgggaattgattcaggaagtagagaagctgggcggtatggcaaaagccatcgaaaccggtatccccaagatgcgtatcgaagaggctgctgcgcgtacacaagcccgtatcgatagcggttcgcagaccattgtcggtgtgaacaagtatcgtctggagaaagaagctccgattgatattcttgaaatcgacaatacggctgtccgtcaggaacagattgagaacctgaagcgtctgaaggaaggacgtaaccaggcggaagtggacaaggcattggaggctattactgaatgtgtaaagaccggtaagggaaacttgctggaactggcagtcgaggcagcccgtgtccgtgccactttgggggaaatctcttatgcttgcgaaaagattgtaggacgttataaagcagtaattagaactatatcaggcgtgtattcatcagaaagtaagaatgacagcgacttccaccgtgcttgtgaattggcggagaagtttgcgaagaaagagggacgtcagcctcgtatcatggtagccaagatgggccaggacggtcacgaccgcggtgccaaggttgttgcaaccggatatgccgactgtggcttcgatgtggatatgggacccttgttccagacaccggccgaggctgcccgtgaagcggttgagaacgacgttcatgtagtaggggtttcttcattggctgccggacacaagacattggttccgcagattatcgaagagctcaagaagttgggacgcgaggatatcgtagtgattgccggtggtgtaatccccgcgcaagactatgacttcctttacaaggcaggtgtagctgccatctttggccccggtactccggttgccaaggctgcttgccagatattggaaatcttgttggatgaagaataatccgacacgttaaatgttaaaagagggacggtatgtgtttacatatccgtccctttttcttaatctgtgttatagaacatacttttttagttggataatttgcagatttatcagaagtccgtatctttgcaatgtgtttttcatagtattagatttaaggttaacaaaggttggagtacagcggtactcctttttttatgtccgtacgtcagctttgggggagaaaaatcacctggtctatgttatcgtttcttgcttatagtttcgttcttgccccctttttattacctttgtcccgctaaaagaataacgaatgatagtttgtattgccgaaaagccctctgtggcgcgtgacatagctgatgtattgggagcgaaagaaaagaaggacggatacatcgaaggaaacggataccaggtgacctggacattcggtcatctttgtacgctgaaggagccgcatgaatatacccctaactggaagtcatggagtttgggaagcctccccatgatacctccccgtttcggcattaagctgattagcaatcccacatacgagcgccagttccatacgatagagaacctcatgcaacatgccgatatgattataaactgcggtgatgccgggcaggaaggagaattgatacagcgctgggtgatgcagaaagccggggcacgttgcccggtgaaacgtctttggatatcttcattgacagaggaagccatccgtgagggctttgccaagctgcgcgatgcgtcggatttccagcctttgtacgaagcaggcttgtcgcgtgccattggcgactggctgctcgggatgaatgccacccgcctctacaccatgaagtatgggcagaaccggcaggtactttctatcggccgtgtgcaaacgccgacactggcgctgattgtaaaccgtcagttggaaatacagaattttgttcccaagcaatactgggaactgaagaccgtctatcgagataccactttctccaccatcctccggaaaagtgaggaggaactggtattggaagccgagaagcagaaagaggctatagctgccgggaagaaacctaaaaaagaagaagagaatcggggtatcgaccccattaccgaccgcgaacgtgggcttgttttattggaccagattaagaattctctttttaccgtgacggatgtcaccaagaaagaggggagggaggcgccactccgcttgtttgacttgacttctttgcaagtggaatgtaacaagaagtttgcctattccgctgatgagacgctgaaaatcatccagtctttgtatgagaagaaagtggctacctatccacgtgtagacactacctatttgagtgatgacatctatcccaaatgccccggcatcttgaaaggtctgcgtgattacgagacatttacagcccctttgacaggaactgcattgttgaagtccaaaaaggttttcgataactcgaaggtaacagaccaccacgccattattcctaccggtcagcatccgcagaatctgacggatatggagcgtcgcgtattcgatttgatagcacgccgtttcattgctgtattctatcccgattgtaagtttgccactaccaccgtattgggcgaggtagagagcatagagttcaaggctaccggcaagcagattctggaaccgggttggcgtattatcttcggcatcccctcggcacaatcgcaggaggagaaagaggagaagggagaagaggagaatgtgcttccggcttttgtgaaaggagaaagcggaccgcacgtccccgatttgtatgagaagtggacgcagccgccccggccttatacggaagccaccctgctgcgtgctatggaaacggcgggcaagctggtggataacgacgaactgcgtgatgcgctgaaggaaaacggtatcggtcgtccatctacccgtgcagccatcatcgagacgctgttcaagcgaaactatatccgcaaggaaaagaagaacctgatagccacccctaccggtgtggagctgatacagattatccatgaggagctgttgaagtcggcggaactgaccggtatctgggagaaaaagctacgtgagatagaaaggcggacatataatgccggacaattcttggaagaattgaagcagatggtatcggaagtcgtgatgagtgtactttctgataacagcaaccgccacatcaccatccaagcgcctgctcccgaaaagggcagtaaggtttctgccaagacagaggctgccgataagccgaaaaaggagccgaagaaaagaacaccgagaaagtctgccgccgcaggtaaaaagacggagcaggcttcgggcgctgtggcagcttcaagtacggaggcttccgtacaagctgatgacttcgtcggccagccttgtccgctttgcggaaaaggtaccgttatcaaggggaaaacggcttacggttgttccgaatggaaatccggatgtacattccgcaagccgtttgaataagggtaatcacattaaataattctctccgccatgtatttccagaggggagcagccatcagcgcctggcggatgcttccttgttgcagcaagtccttgacctcctgcaaggaaagcaggtgtacggtcaggttctccgtatcttccaagtgttgctcggagattttctccacgtccgtagccaggaaacagtaggtaatgttggtgtgggtacttggattgggagagatttgcatgaactctttccatactccgtttccatagccggtttcttccaaaagttcccgttgtgcggaaaccatcggagagccgtcctcttcttcgcatacccctgcacagagctcataggacgtttcttgtatgccatgccggtattggcggataaagacaaattgtccattacgggtgatggcgatggtattcacccagtttggatattccaatatataataggaggggatgtggttgccgttgggcagcactacatggtccttacgcacagtgagccacggagcccgatgaaggtattcgctggataagacggtccaggtgtcttttgatttttccataatggtaaaattgactatattttaaacagcatccctccgatattatctgtcgtggctcccgtcaccgaggcgaggcatccgggtgtgtccgccatatagagggcacccaggaaagcaaagattagggcttccttgtattctatgatttgccggctgggaatcacgatttcacacggacacaaggcgtcgatacgttctatgaggaacttgttgaatgcacctccgccggtaatcagcagttttccgttaccatcgggcaaggggcgggcggtgatgatgcgtgatatttgccaggcggcatgctcgtaaaaggtacgtagcatattctccatactcaagccataacgctcgagcatgggatataccagcgtttccacccactcccgtcccaatgacttcggtccggactgatggtagaaatccattccgttcagttcgtccagcagttcttggcagatgttgccttgccgtgctatctcgccgtcacggtcaaattccaatcctatttgccggcagtaatggttgatgacgtaattcaccggactgatgtcaaaagcgatgcgccgcccgtcctgctcgaatgagatgttggagaaaccgccgatattcaaacagaagtcgtagtcggcaaaaagcaaccggtcgccaataggtacgagtggagcgccctgcccacccagcatgatgtccagccgccggaaatccgaaacggtaggtatacgggtttcagcggcaatggcggctccgtcacctatttggtacatgattctcttttgaggctcatggaagatggtatgcccgtgggaggcgataatatcggggtggactccaaattcttgcatgaactcgttgacacgttcaccgagaaactttccataggagctgtggaaagtgatgaactccaaagcactcattgtctgtgcaccggtacccaatatctgcttcatggcgtcggggtagctatagccttttgcacagtctatgtggaaagaccattttccggcttgctgccggaaagtgcaacaacatacgtccagcccgtcaagggaagtgccggacatcaggccgatggcttgaatttggaagtctttcatcctgattttcttgttttatttataattgaggtagaattcgacaacagcttctattcctttacggaagatgtccaatggtatattctcattaggtgagtggatggcgttggattcgagcccgaagcccatcagaacggttttgatgcccagtacttgctcgaaagtggagatgatggggatacttccaccccgacgcactgccagcggtttctttccaaaagctttttcaaaacctttttcggcggcttggtaggcgggtagggtgatgggacatacatatccttggcctccatgcatcggagtgacttttacctgtactgaatccggcgctatgtccagaatgtagtcggcaaagagccgggatatcttgtggtggtcctggtggggaaccaaccggcaggataccttggcgtatgccttggatgggagcacggtcttggacccttcacccgtatatccgccccagatgccgcatacgtcgaaagacggacggcaactgttacgttccagcgtactgtaacctttctctccgaaaagtgcttttacatggatagcctttttgtatttctcttcgtcgaaaggaatgcgggctatcatgtcgcgctcggtttggggaacttcttccacatcgtcatagaagcccggtacggtgatacgtccctctgcgtccgtcacttggctgattatctggcaaagtacattgatggggttggcaacagcaccgccgaagtgaccgctgtgtaggtcgcggttggggccggtcacttctatttcccaataggccagtccgcgcagtccggtggtcagtgaaggcaggtctgcaccaagcatgctggtgtccgaaaccagaatgacgtctgctttcagcaactctttgtgctcctggcagaagctttccaggctgggcgagccgatttcttcttctccttcgaagatgaattttacgttggtttgcagcagtccgtttctgacgaggtattcaaacgctttcacttgtatgaaagattgccctttgtcatcatcagcaccacgtgcccagatatgtccgtcgcgtatttccggctcaaagggttcgcttttccaaagttcgagaggttcggccggcatcacgtcgtagtgggcatataccaatacggtcttggcgtccgggtctacgattttctgtccaaaaacaatcgggttgcctttggagggcattacgagggcttcatccgctccggcttcgagcagcaactgtgcccagcgttcggcgcaggcaagcatatcgtcgtgatactcgggtttggcactgatgcttggaatacggatgaggctgaacaagtcttccagcattttagactcgttctctgtaatatatttctttatttccataggtgaatattatagctgagttgttctgtcaatcaggtaataatccagcaatgtcattgctgccattgcttccacgatgggtactgcgcgtggcaatacgcacgggtcatggcgtcctcgggctttcagggtggtgtctacaccgtcaatgttcacggtgtgttgttccatcagtacggttgccacgggtttgaaggctacacggaaatagatgtcttgcccgttgctgattccaccttgtatgccgcccgaatggttggtgcgggtttcgatacgtccgttgttattgtagaacacatcattctgttccgagcctttctgctttaatcccttgaagccgtctccatactcgaatgcttttgctgcattgatgctgagcatggcggctccgagtgctgcatggagtttgccgaatacgggttgtcccagtccgatggggcatcctttgacgacacaggtcaccactcctccgatcgtatctccttctccctttatcttgaagatgagttcttccatttcttttgccttcgccgggtcggggcagcggaccggattggtctctatcaggtcgaggtcgtatgcggtatagttttcttcaaggcggataggacctacttgtgaagtgtacgccgtgatgtgtatacccagctgcttcagcgccaatttggccagggcacccgctactacacgcgagattgtttcacgggctgatgaacgtccgcctccgcggtggtcgcggatgccatattttactttataagtatagtcggcgtgtgacgggcggtagacttctttcagattattgtaatcgtcagaatgctggttttggttccatacaatgaatcctatggggcagcccgtggattttccttcgaagatgccggagaggaactccactttatcaccttctttccgggcggtagtgatacgtgactgtccggggcggcgtcggtcgagttctgcctggacgaaatccatatcaatgactattcctgcagggaatccgtctataactcctcccacacccttaccgtgcgattccccaaaactggtaagacggagaatatttccaaatgagttgaacatatcaaatgctttaaaggtttatatatgaggttaatgtgccaatacgctttataagaaatgcttttgactttataaagataacaactttttttcataaaacgtttaaggaaataagataaaaagtcttttccgcataaagttgcctgcctttgccagagtttggccaatggcttgttctttataaaaatggcttactctttatgaaatctgcatccgaatttcactcgtaatgatgaaaaaaggaacatttattttttagaaaagaccttgtactgtaaccttaaaaagtgttactttgcacctttgatttaaaatgggaaattaatagctcccttgggaagctttttattaactaaacaagtactcaagaaagtatgaaaaagaatttattttatttatttgcattgatctgttcaatgagtttattcacggcttgtagtgatgatgacgatgacaaggtagtatgtcctgtgccgcaaacagagtttacagttgcaacaggtttgaacttgacttataacggtggaacaatgttgggaaagaaagtaacttttactccggatgcttctgatgcaaccaaggctactttggtattggctggcaatttggatctttccggtattcttacacgtgaagcggcttccggttcttttggcgcaggcgtattcccgggttctccggttgtaacccttccggttactttgaatatacaaggtgacgaatgttcgttttccggcacaagtgagaccgattattgtacttttgactatgcaggaaaggttactgcttcttccttgaaattggatttaactaatgtcgcattgaaaaattccgctttatccggaacaacttgggttcctacaccccttaattctgattatacggaagaaccgattcatttgatttgggaatccaataagaatgtagaggtaatgcctggctgggggctaccgattcaaacaattttgacgtcagctctttgtatgcctttaattgacgcaggtggtgatgataaagtgaatgtagaagatatgttgtgtagtgtgttgcatgatattactttgggtgctgacggtaatatttctgcttcttatgttgatgccgctcagggaggtacctctgttgttaagactcctgcgaatgttgcacaatatgtggttctcagtaatacccaaatgaaggtatatttgaatctggatgctatcatcgccaatgtaaaacgtctgggcagttctaccaaggctatcgatatgagtgaaatcttgtctcaggctgttacgtctttgcttcctttggtaactgacggtgtgcctttgacttacaaaaagaacgaaggtaaattaaaggcttatttgaatacggatttgttattgcctttgatgaaaaatatagttgctcctttattctcggatgaggagtttgtgaatatgcttatcgaagcaatgaaagctgatcctgattttggaagtatggccggtatggcagaaggtatgttgaagggtttacctgaaataattaatgaaacaactcgtttggaagttggtttgaacttgactgccgctaaataacttttttttcgatatggaattttccctcctttgtctcctgattttcaggttatagaggagggatttttgtttgttttttcctacatttgcatgataaataatcaaattgtagaaatgatatgacagaaacggaaagacgacagattattgctttggttaaatctgaagtaattcctgccattggttgtacagaacctatagctgtggcattgtgtgtagcaaaggctgcggaagtgctgaataagcgtcccgaaaagataactgtattgctgagtgccaatattctgaaaaatgcaatgggagtgggtattccaggtacggggatgattggattaccgattgctgtggcgcttggcgccttaataggtaagtcggcatatcaattggaggttttgaaagaaagtactcctgatgcagtggaggcaggaaagcgtttcatagaagaaaagcgcattcatatatctttaaaaaacgatatggaagagaagctttatatagaagtatgttgtgaagctgatacggacaaggcaacagctattattgccggtgggcatacttgctttacttatataacgcgcaacggtgacatcttattggacaaacaaattgcctcttgtatcgaagaggaggatgtattggacttgactttacgcaaagtgtatgacttcgccatgacaaccccattagacgacatccgttttatccttgaaacggcccgtctgaataaggcggctgcagaacgttcttttgagggtgattacggacatggtctgggaaaaatccttcgcggtacttatgagcacaaggttatgggggatagtgttttttcccatattctttcttatacttccggtgcctgcgatgcccgtatggcaggagctatgattccggtcatgagtaattcaggaagcggtaatcaaggtatatccgctacgttgccggttttgatttatgccgaagaaaacggaaaatcggaggaagaattgatacgcgccttgatgttgagccatttgacggtaatttatatcaagcagagtttgggacgcttatctgccttatgcggttgtgtggttgctgctacgggttccagttgcggtataacttggctaatgggaggaacttatgaacaggtggcatatgctgtacagaacatgattgccaatcttaccggaatgatttgtgatggtgccaagcccagttgtgcattgaaagtaaccaccggagtttcaaccgcagtgctttcagccatcatggccatggaaaaccgttgtgtgacttccgtagaaggtattattgatgaggatgtggatcaaagtatccgtaatctgacaaaaatcggttctaaaggaatgaatgaaactgataaattggtattggagataatgacaagtaaataatatagaatttgaaaattaaagaattaaaaattaaagaattaccatgcggcatgcttaatactgtgtagtctgattctttaatttttaattctttaatttttaattctttagtggcagcatccgcctccacattcatggtcgccgcatccgtcgccacagtcaccacaaccgcagctaccacaaccgccacccatcatacgggcaacttcagcaagctcttcgttcgtggccgggcggctttccaccacttctccggtaaagttcaaatcacaacctgcgagtggatgattcatgtccattacaactacgtcttcctttacttctactacacttccattgatgcgttgaccttcagaagtcatcaaggggatgacagcgccttccactacacggtcgctgtcgaattctccttctatcatgaagatttctttggggaggtcaatgacatggtcgtcgtcatattcaccataagcttctgatgccggaatggtaaagtcgaatttatcgcctatctgcaagtcttttatctgggcttcaaaaggttcgagtgtcattcccagacctgagataaactggaaaggatgctctacgggtgcttcttcttcgaaatctttttctccgttttcgattgagtacagcttatatgctacggtgatgtacttgttttctactgtttccattaattttctatctttatttaattagtaaatactgtttttttgagtatttgaagagacaaagatacgaattatttgtttcgggatgtagagagcctttggtaattttcagattattaaatggtttcaatgattggcaatacatttacattggctgtctgaatggttctatttagaactgttaagtgataaaataggattttagggcgattttttcttacgattattcatatttatcttatttttttcttcaatttgtttggagattataaaaaagcccttacctttgcagcacgtttgaaacaaaaaagaagaattaagttatgaatttacatacatctattaacctggcagtcctgcatattattcgcgtcgtggtggtggcatcaagagcgtgagaaaggttatgtatgtattcgtacgttagaagataatttattaagcctttctcactatagtgggagaggctttttcattaaaaggagatttgaaaatgaagcatcagttacgcagctcgttcagcacacaaggtcgccgcatggcgggagcccgtgcattgtggacggcgaatggtatgaagaaggaacagatgggtaagcccattatcgctatagtcaattcatttacacaattcgtccccggacatgtacacctgcacgaaataggccagtttgtaaaggaagagattgaaaagctggggtgttttgctgcggagttcaatacgattgccattgacgacggtatcgctatgggacacgacggtatgctttattccctgccttcaagagatatcattgccgatagtgtggagtatatggtaaatgcccataaggcggatgctatggtttgcatcagtaactgtgacaagattactccggggatgttgatggcggctatgaggctgaatataccgactgtgtttgtttcaggcggtccgatggaagccggggaatggaacggacaacatttggatttgattgatgctatgattaaatctgctgatgaaagtgtgggcgataaagaggtggcacagattgagcaacatgcctgccccacttgcggatgctgctcaggcatgtttaccgctaattccatgaattgcctgaatgaagcgattggattggcactgcccggtaacggcacgattgtagccactcacgaaaatcgcaagagactgtttgaggatgcagctaagttgattgtagcgaatgcctttagatattatgaagaaggggatgagagtgtactcccgcgcagtattgctactcgcgaggcatttttgaatgccatgacgctggatattgcgatgggcggttccactaatacagtacttcatttgttggctgtggctcacgaagccggagcggattttaagatggacgacattgacatgctctctcgcaagaccccctgcttatgcaaggtagctcccaatacccaaaagtatcatgtacaagacgttaaccgtgccggtggcatcattgccatcatggatgagcttgccaagggcggattggtcgatacgaatgtccgccgtgtggatggaatgacgttggcagaggcaatcgaccggtatagtattaccagctctaatgtatgtaaagaggcaatcaagaaatactccagtgcggcagccggaaagttcaatctggtactcggctcacaaaatgcgtcttataaggaactcgatacggaccgtgcgactggttgtatccgtgatttggaacatgcatacagcaaggatggcggtctggcggttttgaagggaaatatagctcaggacggttgcgttgtcaagactgccggtgtagacgagagtatctggaaatttacggggccagcgaaagtcttcgactcacaagatgcggcttgtgacggtattctgggtggaaaggtggtcagtggagacgtcgtcgtcatcactcacgaagggccgaaaggtggaccgggtatgcaagagatgctttatcctacttcttatatcaaatcccgccatctgggtaaggagtgtgcattgattaccgacgggcgttttagtggcggtacttccggactaagtatcggacatgtttctcccgaagcggctgccggtggtaatatcggcaagattaaggatggggacattatcgaaattgatataccgaaccgttctatcaatgtgaagttgacggatgaagagcttgcagcacgccctatgactccggtaacccgcaaccgtgaagtctccaaagcattgaaagcatatgccagtatggtgagttccgctgacaaaggggctgtgaggctgattgattaaaagcccccctttccgaaagcgaggggaggagagaatgaaacaaatttttcaagctactattgagcttttaaatataatgaatagataaagtatggctgataataataaaaagagtaacttttcctccctctcccaaggagagggtcggggtgaggctctaataacaggcgcagaagcattgatgcgctctctggagcatcagggagtaaagactattttcggttatccgggagggagcatcatgccggtattcgatgccttatacgaccatcggaaggaattgaaccacatcttggttcgtcatgaacaaggagcaacccatgcggcacaaggctttgcacgtgtatcaggcgaggttggcgtttgtctggttaccagtggaccgggtgctaccaatactatcacgggcattgcagatgccatgattgacagtacgcctatcgttgtcattgccggccaggtagggacgaacttcttgggtacggatgcatttcaggaagtggacttggtaggcattactcagcctatcacgaaatggagttaccagattcgtcgtgcagaagatgtggcctgggcagtggcacgtgctttctatgtggcaaagagcggacgtccgggaccggtcgtgctggattttgctaaaaacgcccaagtggagaaaacagaatatgcgcctactaaggtggactatgtccgtagctatcttcccgttcccgaaatggagccggaggccatacggaaggctgctgaattaataaatggtgcgaaacggcctttggtgctggttggacaaggcgtggagctgggagaagcccagcaagagcttcgtgctttcattgagaaagccggaatgcctgccggatgcactttattgggactttccgcattacctacgaaccatccgttgaacaaaggaatgcttggtatgcacggtaacctggggcccaatatcaataccaataaatgtgatgtccttatcgccgtaggcatgcgctttgatgaccgtgtgacgggtaaattggaaacatatgccaagcaggcgaagattatccactttgatattgaccctgccgaaatagataagaatgtaaagactgatgttgctgtcctgggagattgcaaagagacactggctgccgttacccaattgctggaacccgccaaccatcaggaatggattgacagtttccggcaatacgaggaagtggaagaggaaaaggtaatccgtccggaattacatccggcaggaaaagcgctaagcatgggtgaggtggtgcgtgctgtgagtgaggctacccataacgaggcgatattggtgactgatgtcggccagaatcagatgatgtccgcccgttatttcaaatacagcaaggaacgtagcattgttacttccggtggtctgggtactatgggcttcggccttccggcagctatcggtgccacttttggacgtccggaccgcacggtatgcgtattcatgggagacggcggcttgcagatgaacctgcaggaactgggtaccatcatggaacaaaaggctccggtgaagatgattctgttgaacaataacttcctgggcaatgttcgtcaatggcaggcgatgttcttcaatcgtcgttattcgtttactccgatgatgaatccggattatatgaagattgcttcggcatatgatattcctgcacgcagggtaatgacccgcgaggagctggcaaaagcgattgacgagatgatagcgactgacggaccgttcctgctcgaagcttgtgtggaggaagaaggaaatgtaatgccgatgacacctccgggcggttcggtcaatcagatgttgttggaatgctgaagtcatgcgaaattaaagaatttactctatctatggataaaaaactatatacaatcattgttcattcggaaaactttgccggtttgctgaatcaggtgacggctgtgtttacccgccggcagataaacatcgagagtttgaatgtatcggcctcctccatcaagggggtacataaatataccattaccgcttggacggataaggataccattgaaaaggtgaccaagcagattaccaagaaaatagatgtgctgcaagcccattatttcacggatgatgaaatctatcagcacgagattgccctttataaaataacgacccctacgctggaagaaaaaccggaggtgtccaaagtaatccgtaagtacaatgcccgtattgtggaggtgaatgctgtatttgccattgttgagaagaatggcatgagtgaggaaataaccaatctttatgaggagttgcgccagttggattgcgtacttcagttcgtccgttcgggtcgcgtagccattacgaccagctgctttgagcgtgtcaatgaatatctggcggaccgtgaagcaaaatatcgtcaaagtaaacaccaggaatcatgatgagcgagaacaataaaataggtacctacaagtttgttgccgaaccgtttcatgtcgactttaccggacggctgacaatgggagtattgggcaaccatttgttgaattgtgcgggtttccatgccagcgaccgcggttttggcatcgcgactctaaacgaggacaattatacttgggtattgtcccgtctggctgtcgaactggatgaaatgccttatcagtacgaagatttctccattcagacttgggtggagaatgtctatcgcctttttacagaccgtaatttcgctatcatcgataaggagggtaagaagattgggtatgcacgttccgtttgggcgatgattagcatgaatacccgtaagccggcagatttgctggctcttcatagtggcagcattgtagattatgtttgcgatgagccttgcccgatagaaaaaccttcgcggataaaggtggcctcaaaggaaccggttgctgctttggtagccaaatacagtgatattgacattaacgggcatgtgaacagcatccgttacatcgagcatatccttgatttgttcccgatagagatgtataaggagaagcgcatccgtcgttttgaaatggcatatgtagccgaaagctattatggggatgagttgactttgttcatggatgatgccggtgagggcgtttacgatgtggaggtgaaaaagaatggcagcgaagtggtctgtcgctctaaagtgatatttacagagaaataaataaatttatcaacgttggcgtaagccacaaataaaaattaaaacaaaaaatggcacaattgaattttggcggtgttattgagaatgtaatgacccgcgaagaatttcctttggaaaaagcacgtgagattttgaaagatgaaacaattgcagtaatcggttatggcgtacaaggcccgggccaggcttgcaacttgcgtgataacggtttcaatgtgattgtaggacaacgtccgggtaagacatacgaaaaggctgtggctgacggatgggtaccgggtgagactttgttcggcatcgaagaggcttgtcagaaaggtactatcgtcatgtgtctgttgtctgacgcagctgtaatgtctgtatggccgactatcaaaccttatttgactcccggaaaggctctttacttctctcatggttttgctattacctggaacgaccgtaccggcgtggttcctcctaaagatattgatgttattatggttgctcccaaaggttccggtacttcacttcgtaccatgttcctcgaagggcgtggcttgaactcatcatatgccgtctatcaagatgctacgggtaaggcttttgacaagacgattgcactgggtatcggtatcggttcgggatatttgttcgagacaactttcatccgcgaagccacttccgacttgaccggtgaacgcggttcattgatgggtgctatccagggattgctgttggctcagtatgaagtattgcgcgaaaacggccatactccttctgaagcattcaatgaaacagtggaagagttgactcaatctttgatgccattgtttgccaagaacggtatggactggatgtatgccaactgttctactacggcacagcgtggtgcgctggattggatgaccccgttccatgatgccatcaagccggttgtacagaaattgtatgcaagtgtgaagtcgggcaacgaagctcagatttctatcgacagtaactccaaacccgattatcgtgagaagctgaatgcagaattgaaagccttgcgtgaaagcgaaatgtggcagacagctgttacagttcgtaaacttcgtccggaaaacaattaatcagctttatataaataggtgaaataccctcttcggtgttaccggagggggtatttctttattattgattccctatattttgaataaactccaatagcttccggtaaaaaccgtgatgtttcagcgtctctgcctctcccaatatcaccagcttcatacgtgcccgggtgatggctacattcattctccttaaatcattcaggaatcctatctgtccttcttcgttggcacggacaaggctgatgaagataacatcgcgctcttgcccttggaagccatccaccgtatttacagtgaacaagctgcgataaggcttgagtgaagcgtctgcctttatcttgctgcggagatattgcacttgtgccttgtaaggggagatgatgccgatgtctattttttcttccagaatgcggttgccaccgatacggttgatgtagattttcagttctgataggagcaggtccgcttccgccttattaatgcgtccgaaagtctctcccacaaattcttctttgaaatccatttcggaggtgtcaatccagtggatgggggtatcccagtccaggatgccccggtaacgcacttcgggagcggcttccaactcgccattataaaaccattgggaaggaaatttcatgatttcctcgtgcatgcggtattgtactttcagcaaagagacaacggcaggtttgttggacaccactttctccatcaatgttcgttccagacctccacgggcagcttcgtagcattttatagtgggcggaagttggcagtggtcacccgccaacaccacgcggtctgcttttcggatagctatccagcaggcagcttctaaggcctgggctgcttcatcaatgaaaagggtgccgaaacggcgtccgttcagcagccggtgattgctgcttactagcgtggaggctatgacatgtgccccatcaaaaagctctgcattgatttgtatttccaatgcggtggcgcggtcgcgcaggcggctcatacggctgcgtactccttcgcgttcgtcatagctgccacggcgggcacggctgcccagttcacggagatttttccggatgctccacagctccggataaagcggatggttctcgaaacgacgctcgtaggtaaaggaaagcatcttgtcgttgacacgggtcggattgccgatacgcaggacattgacgccacggtctaccagtttttccgaaatccagtcgacggcagtattgctttgggcacataccagtacctgcggttcccgatgcagggtttcgtagatggcttccactaaggtggtcgtttttccggttcctggaggaccatgtacaatggccacgtcgcgagcacacagcactttgtttacagctgtttcctgcgtggagttcagccagggaaaccgtacgggatagagctctcggaaaccggctttcgaggttcccagcaatatgtcccgcaattcggccaggcggttgcctttggagcgtaacgtatcttccaaggcttcgaacatggtccgataggatgtttcgtcgaaataaagttgcacgccgaggttgtccgtttcctgcacttccatcacggcaccggctccgggcattatcgctaccatccgtgtctcgtcggcatagcttacggtagcggtgaagttcatataggttatttttccatcggcagactggcggaaaaaacatacgggacggccgaactcaaaattatgttctatatcggtattttctgtgtgtgtaatttctattactaattgattcagtgaattatagtaacttcgtcccggagtggcaggataccagcaaagtccccgtttcactttccgggcaacccccatgttttcggtttggcgtttgaattcctctttttcgtattcgtattccatgcgcagcaaaagttgttgctgctggaggtgaataataggactatttgaatcttgttccttcatggttgcaaaggtaatcattcttcgcttccgacggaaaaaatgctttattttgttaaactattcagcctttttatttgtttatgatattaatttgtaatctttacaataatgaaaaactaaaaaatagtggttatggtatatgatttaacgatgctcaaagcgttttatgccgcttattcggagaagatagaacgtgtacggaatgtactacagcgtccgatgactttagcggagaaaattttgtatgctcatttgtatgatggggataaagtgaagaactacagacggggagaagactatgtgaatttccgtcccgaccgtgtggccatgcaggatgcaacggcccaaatggccttattgcaatttatgaatgcaggccgtgagcaggttgccgtgccttccactgtgcactgtgaccatttgattcaagcatataaaggtgcaaaagaagatatcgcgactgctacgaagaccaacgaggaggtctataattttctccgtgatgtttcttcccgctatggcataggtttttggcagccgggagcaggcattattcaccaggtggtattggagaactacgcatttccgggtggaatgatggtaggcacggactctcatacgcccaatgccggaggtttgggcatggtggccattggtgtgggtggtgccgatgcggtggatgtgatgactggcatggaatgggaattgaaaatgccgcgtctgataggcgtacacttgaagggtaaattgagtggctgggtagctcccaaagacgttattctgaagttggcgggtattcttactgtaaaagggggaaccaatgccatcattgaatattttggaccgggaaccgcttcattgtctgccactggaaaggctaccatctgcaatatgggggcagaggtgggggcgactacctcccttttcccttacgatgagcgcatgggtacttatttgaaggctaccggacgtgaagaagtggcaaaaatggctgcttccgtagctgccgaccttcgcgccgacgacgaagtgctggcaaatccggaaaaatattacgaccgcatcattgaaatagacctctcgctgttggaaccgtatatcaacgggccctttacgccggatgcagcaacaccgatatcgaaatttgccgaggtagtgataaccaataactatccccgccggatggaagtcggcctgatagggtcgtgcaccaattcgtcctatcaggatttgagccgcgcagcctcccttgcccggcaggtaaaggaaaagaatttgaaggttgcttccccgctgattgtcaaccccggctcggagcagatacgtgctactgctgaacgcgacggcatgattgccgctttcgaagatattggcgcaacgataatggcgaatgcctgcggaccttgtattggccagtggaagcgccatactgatgaccccggacgcaagaattccatcgtcacctcttttaaccgtaattttgccaaacgtgccgatggaaatcccaatacttttgcttacgtcgcttccccggagataacgatggcactgaccattgcaggcgacctctgtttcgaccccttgcgggatacgctggtcaatgccaaaggagaggttgtgaaactgtccgaaccggtcggtgaggaattgccggcacacggattcatcggaggacaaaaaggatatattgctccaaacaagggacagacggaaattacggtcaatcctcattcacagcgcttgcaactgctgactcccttccctgcctgggatggcatggatttgctggacatgcctttattgattaaagtacaggggaaatgtaccaccgaccacatttccatggcagggccatggctacgtttccggggacatttggagaatatttcggacaatatgctgatgggggctgtcaatgctttcaatggagagacgaacaaggtttggaaccgctccaccaatacctatggaacagtgtcaggcactgcgaagctgtataagtccgaaggtatcccttccatggtcgttgccgaagagaattatggtgaaggttccagccgtgagcatgctgccatggaaccgcgcttcctgaatgtacgcgtcattttggcgaagagttttgcccgtatccatgagacgaacttaaagaaacaaggcatgttggcgctgacctttacggataaggccgattatgacaagattcgggaacgcgacctgatttctgtcatggggctgaaagattttgctccgggacgcacgttgaaggtggttcttcatcacgaggatgggagtaaagaaagttttgaagtacaacatacgtataacgaacagcagatagcttggttccgggccggttctgcacttaatgcaagatagaatatggaaaaaattactgtaccttttattaccggcgatggagtgggagcagaagtgaccccatccatgcaggctgtcgtgaatgccgctgtcaagaaatcctatggtgaccggcgtggcattgaatggaaagaagtgctggcaggagaacgtgctttccacgaaaccggctcctggttgccggacgaaaccatggaagccttccgcacctataaggtgggcatcaaaggtcctttgacaactcccgtcggtggaggtatccgttccttgaacgtagccttgcgtcagacgctcgatttgtatgtctgccaacgtccggtacgttggtataagggcattgtttctccactcaaagagccacagaaggtggatatgtgcgtattccgtgagaataccgaggatatttatgcaggcatcgaatgggaagccggaactccggaggctgaaaagttctatcgttttctccgtgatgacatgggggtgacaaaagtccgttttcccgaaacctcctcgtttggcgtgaagcccgtttcgagagaaggaacagagcgcttggtgcgtgccgcctgccaatacgcccttgagcatcatctgccttccgtgaccttggtacacaaaggaaacatcatgaaatttacggaaggcggcttcaagaagtgggggtacgaactggcagaacgtgagtttggtaaagaactggcagaagggcgtctggtcatcaaggactgcattgccgatgcattcttgcagaacacgttgcttatccccgaagaatattccgtgattgccacgttgaatctgaacggcgattatgtgtccgaccaactggctgccatggtaggcggcatcggcattgcaccgggtgcgaatatcaactataaaacggggcatgccatctttgaggctactcacgggacggctccgaacattgccgggaaagacattgtgaatccttgttccatcatcctttccgctgtgatgatgcttgaatatctgggttggaaggaagctgcctctcttatagagaaagctttggagcagagtttcaccgaagcccgtgctactgccgacttggcacgttttatgccgggtggcgtctcgctgtccacttcggctttcacccgggagattgtaggaagaatagaaaatgggaataacgaataaaacgaaacgattatgaagaaggagtacctgatttacaagctttccgaagatttgaaggaagctacccggattgagaatgaactgttcaggaagtttgatgtgaagcgcggtttgcgtaatgaggacggcacgggagtcttggtggggttgaccaaaataggcaatgtggtcggctatgaacgcatccccggtggagggctgaagcctattcccggcaaattgttctaccgcggttatgatgtggatgacttggcacacgccatcatcaaagagaagcgtttcggttttgaggaaattgcctacttgttgctttccggtcgcctgcccgacaaggaagaactctcttctttccgtgaactcatcaacgacaacatgccgctggagcagaagaccaagatgaatatcattgaactcgaaggaaacaacattatgaacatcctggcgcgcagcgtactcgagatgtatcgttttgaccctgatgcagatgacacttcccgcgataatctgatgcggcagagcattgagcttatttcgaaattcccgaccatcattgcgtatgcctataacatgcttcgccatgccacccatggccgttcactgcatatccgccatccgcaggaaaacctttccattgccgagaatttcctctatatgctgaagaaggactacacggagctggatgcccgcacgctcgacctgctgctggttcttcaggccgagcacggtggtggtaacaactccacttttaccgtacgtgtcacttcttctaccgggacggatacttactcttcgatagcggcaggtatcggttccttgaaagggccgcttcatggaggtgccaatatccaggttgccgatatgttccaccatctgcaggaaaacattcaggactggacgaatgtggatgagattgatacttacttcacccgcatgctcaacaaggaagcctataacaagaccggcttgatatatggtatcggacatgccgtctataccatttccgacccgcgcgccattctgctgaaagagcttgcccgcgaccttgcccgcgaaaaagggaaagaacgcgagttcgctttccttgaactgctcgaggagcgcgccattgatgtgtttggccgtgtgaagaataatggcaagacggtttcgagtaatgtggatttctattcgggctttgtctacgagatgattggactgccgcaggaaatcttcacgcctttgtttgctatggcacgtattgtcggttggtgtgcacatcgcaatgaagaattgaactttgaaggtaagcgtattatccgtcctgcctataagaatgttttggatgaggtgacttatgtgcccattaagaaacggtaaggattagacttgtatcttttaaatcgttccatcacggggaaaaaatcgttccaccatggtggaacgattttttctccatggtggaatgaaatttactccatgatggaacgattagattttcgtatctctactgcttaatcttctcagtaaaaaacactggtttttgtatgaaaaaacaattatccggggaaaacgatttgtttgttgtgagttttctttatctttgcttcgcataaataaagaactatgaatcaggaaacttttcagatatttctgtgggtaatgagtgctgtggcattggttgtctttattgcactctattttgtcaaagcgggttatggcatgttccgtactgcctcgtggggaatctccatcaataataaactggcgtgggtgcttatggaagcgccggtattcatcgtcatgtttgggttgtgggggaagagtggagcgggatttgccgtgccggtatatttcttcttcctgctgtttcagttgcactatcttcagcgggcctttatttttccgttcctgctgaaaggtaaaagccggatgccggtagctattatggcgatgggtatcgtcttcaaccttttgaacgggatgatgcaggcgggcggtttgttctatttcgctcccgaaggcttgtatgccgatggctgggcctatttgctgaaacctcatgccttgttgggaatcattctgttttttgcaggtatgttcgtcaatttgcattccgactatgtgatacgtcatctgcgcaggccgggtgatacgaagcattatcttcccggaaaagggctttaccgatacgtcacttctgccaattacttcggtgaactggtggaatggacggggtttgccatactcacagcttctcccgccgcctgggtgttcgtctggtggacgtttgccaaccttgttccccgtgccgatgccattcaccgccgttatcgggaggagtttggtgatgaggcggtaggaaagcgcaaacgcatcattccatttctttattaatggaaaatggagagttgaaaatggaaaatgaataattcataacttataactcataactcataacgatggaatccaagttattcacccctgtcactttcggaccgttgaccttgcgtaaccgtaccattcgttcggctgctttcgagagcatgtgtcccggaaacgctccgtcggacatgttgctcgactatcatcggtcggtagcggcgggaggtataggtatgactactgttgcttatgcggcagttactcagagcggcctgtcttttgaccgccagttgtggatgcgtcccgagattatccccggactccgtaggctgactgatgccatacatgcggaaggggctgcggcaggcatccagttgggacactgtggcaacatgtcccataaaagtatttgcggttgtatgcccgtcggcgcatcttccggtttcaatctttactctcctacctttgtgcgcggactgcgtgccgatgagctgccggagatggcgcgtgcttatgggcgttcggtgaatctggcacgggaggccggatttgattctgtagagattcatgcagggcatggctatctcatcagccagttcttgtccccgtccaccaaccatcggaaagacgagttcggaggctcgttgcagaaccgtatgcgttttatggatatggtgatggaagaagtgatgaaggctgccggcagtgatatggctgtgctggtgaagatgaacatgcgcgacggtttccgtggagggatggagctggacgagacgatgcaggtggcgcgcaggctggagcagtcgggagcacatgcgctggtcttgagcggtgggttcgtcagtaaggcgccgatgtatgtcatgcggggcgaaatgcctatccgcagcatgacgcattacatgacctgctggtggttgaaatacggtgtacgcatggtaggcaaatggatgataccgagcgtaccgtttaaggaagcctatttcctggaagatgccttgaaattccgtgccgccttgaagataccgttggtttatgtgggtggcctggtttccagggacaagatagatgaggtgctggatgacggtttcgaggctgtgcaaatggcacgtgctctgctcaatgagccggggttcgccaaccgcatgcgtgccgaagagaatgcacgttgcaactgccggcatagtaattattgcattgcccggatgtattccatcgagatggcatgccatcagcatttgaaggaggaacttccaccttgtctgaaaaaggagatagagaaaatcgaagcgaaaggctgatttttagtttttaattttcaatttttaattattaaagtgaatttagctgttataactggggcagacggtggcatgggcatggaaattacccgcgcagtggcaactgccggctatcaggtcatcatggcatgccgtgacccccaagctgccgaacccaagcggcaactgctgatgcgtgaaaccggtaatccgcgtattgagactgctcccattgatttggcatctctggcttcagtggccgcatttgcagagcatctgttgaagcggggagagccgttggcgttgctgatgaacaatgccggaaccatggaaacggaacgccgcattaccgaagacggactggaacggacggtgagtgtcaattatgtagggccttacctgctgacccgcaagctgctgccattgatgggagaggggagccgtattgtgaatatggtatcttgtacgtatgccatcggtcatcttgactttccggattttttcctccggggaagaaggggggacttttggcgcattcctatatatagcaacacgaagctggcattgactctgttcaccatcgacttggccagtcgcgtcaaacacaaaggtattgttgtgaatgcggccgacccggggattgtgtctaccaatatcatcaccatgcatatgtggtttgacccgctgacagatatacttttcaggccttttatccgtactccccgtaagggagctgcaacggctgtcggcttattgctggatgaggatgccggtaaacgtacggggacattgaatgccagttgccgtcccaagtctctttcggagaagtacacccggcatgtacagatggaagaactgtgggagaggacggaaagtatagtgaaaaaatggttgtaaaaaacagagaaggcgcatatgtcgccttctctgtttatggggtatctgaactgtctgtcattagatagacagttctctcaatacatttacaaggtctttcttgatgggtttgtcattcttgatggccttcgtgaagggaacgtataccacttcatcgtggtcaatgcctatcatgacattgcgctgtccttccatgatggcgtcgatggcggctgcgcccagacggctggcaaggatacggtcgtgtgccgtagggctaccaccgcgttgcaagtgaccgaggatggttacgcgtacgtcatattgggggtattcgttctttacacgctctgcatagtgcattgcacctccggtcagttcactctcggctaccagtacgatactgctgttcttggatttccggaaaccgttcttgatgaattcttccagttggtccacttccgtactgaattccgggataatggctgcttctgctccggaggcgatggcgccgttcagagcgaggaaaccggcatcgcgtcccatgacttctacgaaaaacaagcgctcatgggaagtggctgtatcacggattttgtccacagcatccaggatcgtgttcagcgcggtgtcgtagccgatagtggtatctgttccataaaggtcattgtcgatagttcccggcagcccgatacaaggcacgtcaaactcttgtgcaaagatacgagcaccggtcagcgaaccgtcgcctccgataatcactaaggcgtcaatgccttctttcttcatgttgtcgtaagcaatctggcggccctcgggagtcgtgaactctttgcagcgggctgtcttcaggattgtaccacccagctggatgatgttgctgacattttggcttttgaattctttgatttcgccggttaccagacctttgtaacctctatatatacctttaactgaaagtccgttgtaaatagccgaacgtgtcacggcacgtatggctgcgttcattcccggagcatcacctcctgatgtcaagataccaatgcacttaactgttcccataacaatctttttgtttagtattaataatcatgatgaaaaatagattggaactattttttcatgccgcaaagatagtaaaaagctgaggccgtgactaataaattacgttaatttgctgttccaaaaggatgacaaactgttatttaagttttgactttatggcttctgaaatttcttccatcagccatttgggggtggaagtggctccgcagacaccgatggaattggcaccggctaacagagaactatctatttcttcggcactgtctatcaaatgtgagttggcattgacttttttacactcactgaacagcatcttgccgttagagctttttttgccgctgacaaagaatattaaatcatgggaagctgcaaatttccggatattaggtatccggtttgctacttgtcggcagatagtgtcataggactcgaaagtgactttcggtgagatatgtccctctatgtatttcacaatgttttgaaatccgtccagagactttgtggtctgggagtagagacggatgtctttgctgaaatccagtttccttgcctcttcctgcttttcgatgacgatggcctttccggtggtttgtcctaccagacccagtacttcggcgtgtccatttttgccatagatgacaatttgcttgtcgcggttgtcttcctggacgtactcttgcttaatcttcttttgcaggcggagtacgaccgggcaggttgcgtcaatgatttctatattgttgcggcgggcaatgtcataagtttcagggggctctccatgagcacgcagcagcactttggcgttgtggaggtggtcgaattcctcatggttgatggtaatcagccccattgccttcaggcgttccacttcacggctgttgtgcacgatgtctcccagacaatagagggttcctcctttcgccagttcctcttctgccttgtttattgcggtgacaactccgaaacagaagccggagccttcgtctatttctacttttgccatatccggttcagttcttctcctttataacccgttcgaattgttccgccagccattccttttgttgggaaatgctcaggtggctgttgtccaacaataaagcgtcagaagctttgcgcagcggacttacatcccggttttggtcaatatagtcccgttgtttcacattttccagaatttcgtcaaagctggcttcttcccctttggcctttagttcgtcatagcggcgttgtgcccgtatctcgggggtggcgattacaaaaattttcagctcggcatccggaaaaacggtagtgccgatgtcgcgcccatccataacgatacccttggccttgcccatctcttgttgctgtgccaccatagcttcgcgtacgaaatccaatgttgcaatggggctgacacgtgaagatacttccatggtacggattttgttttctacatttactccgttcaggtaggtatccgggcgtccggtttcggggttcaggcggaaagaaatatgtatatcctttattagacttttcagtttttcggcatctatgcggtcaccctggaaaataccattctctatactatataatgttactgcccgatacatggcaccactatctatatatatgtaaccgatttcgcgggcgaggtctttggccatagtgcttttcccgcaagaggaaaaaccgtcgattgctattgttatctttttcatgacttttatgctatagttatataggtataacacctgcaaaacagaaaatttcaatatttcatttaaaattcttgccaaagatacggtatttttaaaatatctcgttacatttgtggcacaaaagcatgtggaggcttttgaaggattaaaaaaatgaaaaaggaacgtctgttgtgtgaaaaaaaacagcagagcgtgaacattcttgggaaaagtactatatttgccccaaatgagaaacactaaaattatattataaattatggaaattaagaaatcacctaaggcagacctggagagtaagaagtcgacttggctgcttgtcggttatgtaatcgtgctcgctttcatgtttgttgcgttcgagtggacaaagcgtgacatcaagattgatacgagtcaggctattaccgacttagtatttgaagaggaaatcatccctattacagaacagccggagcaggttactcctccgccccccgaagctcctgcgattgcagaaacgctgactatcgttgaggacgatgccgacgtggaagaaactgccatcgtatcttctgaggaattgaatcaggctgtggaaatcaaatatgttcccgtagcagtggaagaggaagaaccggaagaacagactattttcgaggtggtggagcagatgcccgaattcccgaacggtggtatggccggtttgatgcagtatctgagcaagaacattaaatatcctactattgcacaggaaaacggaactcaaggccgtgtaactgtacagtttgtggtcaataaggacggtagtatcgtagatgctaaggtgctgagaggtgttgacccgtacttggacaaagaagctgtccgcgtgattatgggcatgccgaagtggaaacccggtatgcagcgtggtaaacccgttcgcgttaagtataccgtgcctgtaatgtttagattgcagtaataaaatatctataagtgggagaggctgccggaatgcagcctcttttcattatccgctatttcctaaattctgaaaatgccatgtttacagcctccgagcttttagaaagaataaattctcatattgcagaattgcagtttgtccgtactcctcaaggtttatatgctcccgttacctatgtgttgtccatgggcggaaaaagaatccgtccggtattgatgttgatggcctacaatctgtatcgggaggatattacccgtatttttaaccctgcaacggggattgaagtgtatcataattatactcttttgcacgacgacttgatggaccatgcagaccgtcgccgtggcaaggagacagtacataaagtctgggatgacaatgccgccattctttcgggggatgcaatgcttgtattggcttatcagtttatggctcaatgtccggttgaatgcctgaaagaggtaatggatatatttagtctgactgcactggaaatctgtgaaggacagcagctggatatggagtttgaacatcggaaggatgtgaaggcagaggagtatctggaaatgattcgtctgaaaacttcggtattgttggctgcaagcttgaagattggcgctcttttgggaggggcttcttctgaagatgcggagcagttgtatgattttggcatgaacttgggtgtcgcttttcagttgaaagatgatttcctggatgtttatggcgatgctgccgtctttggaaagaatattggaggtgatattctgtgcaataaaaagacctacatgctgataaaggcttttgaacatgcggatgaggagcagttgacccgcttgaatgcttgggtggatgctgttgcattcaacccggaggagaaagttgctgcggtgacggaactgtataaccggattggcgtcaaggaactgtgtgagaaaaagatggaagagtattgtgaacgcgcaatggaaagtctgttggcggtgaaggtggcagatgaaaagaaagaggaattgaagaacctgatggctaacctgatgcatcgggaagtataactttaaatccgggagaaaatgccttatagaagattgcctaatacagatcaagcgagaatacgggcgctgaaagcagtggtcgtcaagggtgatatatgtaatgtgtatgatttggccgtatctttgaaggcgttgactgatgcgcggaattttcttacaaagtttgaagctgcgcaagcttattatgccgactgttttgagcggcaggctcgggcgggacgtaagcatcaggctaatgtaaagactgcccgtctgtatatttctcattttatccaggtgttgaatttagctgtcatccgttctgaagtgcgtattgctcataaggaatattacggtttggacacaagcaacaataatgtgcctgatttatcgacagagcctgccttggcagagtgggggcgtaaaatcgtggatggggaaaacaaacgtatatcccagggaggaattcccatttataaccctacgattgcaaaagtgagggtgcattatgatattttcatggatagttatgagaagcaaaagaatcttcaatctttgacagcccgcagtttggacaccttggcttcgatgcgtgcagaggcggatggtttgattttggatatatggaaccaggttgaaaagaaattcgaggaggtcactcccaatgagaaacgtttggatttatgccgtgattatggaataatctattattaccgtaccggtgagaaacgcaaagagtaagttgaagaatgagattgattgattcacattcccatctttttttagaagagtttgcagaggatttgcctcaagtgatggctcgtgcccgtgaggcaggagtcacgcatatttttatgcccaatatcgatagtaccaccataggacctatgcttcgggtgtgccgtgaatataaagggtattgctatccgatgattggattgcaccctacctctgtgggtgcggattatgaaaaggagttggaaatagtggcccgggagctggcttcaccgaatgaatttgttgcggttggtgagattggtatggacttgtattgggataaaacttttctcagagaacagcaaagggggttggacaggcagattgagtgggctttggaatacggtttgccggtagtgctacattgtagggaagcgttcgaccatatatataatgtgttgaaaccctatcagcagactcctttgaaaggaattttccatagttttacggggacctcggaagaggcctgcaggattatggaatttgcggatttcatgataggaataaatggtgtggtgactttcaaaaaatcaactttgccggaagtcttgaagaatattcctttggaacgcatcgtgctggaaaccgattccccttatctgactccggttcccaatcgaggcaagaggaacgaaagcgcatatgttaaggatactttggtaaaggtggccggaatttatgggaactctcctgaaaaggtggcccaggttacttctgataacactttaaaagtgttcggaatgctcaaataagctctttgagattttaaagtttattaattttgagattttatttaatataaaacgggtcgaatgaagcagaacaacaaaaaaaagaatacatttgtagctgaaaacgcttgtggttcgcattttttttgtaatttgcacccgatttcagaaaaggcgtctattggagagatgctcgagtggttgaagaggcacgcctggaaagcgtgtatacccctaaagggtatccggggttcgaatccccgtctctccgcagtgtgatgaaatgaagataaaacaacaaattataataaataaattaattaattaatcttaaaaattagacacacaatgaaaaagttatttgcaattgttgctgtgatgggagtcttaacatttggctcaactcaacttgctcaggctcaagatgctcctgcagctgaacaaactgaacaagcagctgtagcacctgctgctgatgctgctgcccctgctgctatggaagctgccgagggtggtatccacaaagagcttaagactaagtttattgaaggtactgcatctttcatgagtttggtagctatcgcattggttatcggtcttgcattctgtattgaacgtatcatttatctgagcttggctgaaattaatacaaagaagttcttggctgctatcgaagctgctttggaaaaaggtgacgttgaggctgctaaagatatcgcacgtaacacaagaggtcctatcgcttctatctactatcaaggtctgatgagaatcgatcaaggtatcgacgtagtagaaaagtctgtagtatcttacggtggtgtacaagccggttatctggaaaaaggttgctcttggattacattgttcatcgcaatggctccgtctttaggattcttgggtactgtaatcggtatggttcaggcttttgataaaatccagcaggtaggtgatatctctccgacggttgtagcaggtggtatgaaggttgccttgattactactatcttcggtttgattgttgctttgattctgcaggtattctacaactatatcttgtctaagattgaagctttgacaagtgaaatggaagattcttctatctcactgttggatatggttatcaaatatgacttgaaatacaaaaaataattaagatggctaagttatcatataaagtatcatactacgtactgtatgccatgttcgctatcatcttggtagtgctgggcttgttctacttcggtggagatgctcaaggtgatgcagtattgatgagcgttgactcagaaatgtggcaaccggctcagacagatgcattgatttacttgacgtatgctctgttggctgtagctgtaattgctacgttggttggtgtattgttccaattcggatctgccttgaaggataatccgggggcagccttgaaatctttaatcggcttgattgtattgattgttgtagtggttatagcttggactatgggtagcgatgagccgcttactattccgggatatagcggtactgacaatgttcctttctggttgaagattaccgatatgttcctctattctatttatattttgtttgccggtacagtgttggcaatcatttttagtagtattaagaagaaattatcataactgattgaggtaactcaatttaaagagtaattacaatggcaaaaggaaaaagaaaagttcctgatattaactcaagttctacagcggatattgcattcttgttgctgattttcttcttgatcacgacatctatggatactgaccgtggtttggcaagacgtttgccgcctccacccgaaaaagaccagaagattgaggaccagaagaagaaagaacgtaacgttttgcaagtcttcttgaatatgaatgaccagttaatgtgcggtaacgattatattaacgtagaacaattgcgtgcaaaggcaaaggaattcattgccaatccgtataatgatgaaacgaagccagaaaagatttctaagaatgttcctttctttggtacggttcaagtaacggaaaatcatgtggtttctttgcgttgtgaccgtagttcttcctataaggcatatatggctgtacagaatgagttggtagcggcttacaatgagttacgcgatgaactggctcaggagaagtggcagaagaattatgtcgagttggatcaagaacaacaagatgcaattcgtgatatttatcctcagagaatttctgaggcagaacctaaaaagtacggagaaaagaagtaatgggaaaatttaataagactggtaaacgtgaaatgccggcgttgaacacttcttctctgcctgaccttattttcaccttgttgttcttcttcatgattgtaacaactatgcgtgaggtaacattaaaggttgagtttaaggttccgcaagctacagaattggagaaacttgaaaagaagtctttggttacgtttatctatgtaggaaaacctactgccgaatttcgtaagaagttaggtaatgagagccgtatccagttgaacgacagctatgctgaagttgctgaaattcaagattacattattggtgaacgtgccagtatgaaagaagaagatcagccgcagatgacagtgtctttgaaagttgaccaagatacgaaaatgggtatcgtaacagatatcaaggaagctcttcgtcaagcttatgctttgaagattaactattctgcgcaaccgcgtcagtaagagttgatttaatgatataataaaggtcgtttcatttgttgaaacgacctttattgttttaagtatattggatttttaagatttcacattatatacttcgcagtagatgtgttcctttacaaggtcaaaatcctttccacattctatatctccataggccatgatgagcataggcaggtagttgtctcctgctttatagggaggctgttggtagggcttttcccataaggagaatccttgccgttgatagaagttaatgcggcgtttagccatttcttcttcgggtatttccacttccaagacaatgggatgttttaagagttggcacaaatggttcagtacactctttccatatccgccgttacgctgtgtggggtcaatggcaaaatgctctatatagtaaaaatgtccgaaatcccagtaagtgatgagacctaccggggtgttgttatggaagatgatattgttatagaagtgcgttttggtatctgtatacttgcgcaattcctccagttcccggtactcctctgaagggaacgattgagtcattaatttctccatgtagctgtacaagtctgtgtcagctgttgtaatacgttgaagtctgatcataagttcttttagtttagtttgtttttattcagtataaaattcaatgacgcggcagatggcccgttggcagaccgggcagaaagtagggtattcattggtgcgcatgcggcaattgtctgccggacggtagatgcctttggcagaatagccagctccttcatatacgcctacgggatatgttccactttcagaagagggagtaggaacgggagttccttgagcaagcatatctttccatttggaagtgaaatcgattcttgtgctgatgttctgttcccagggttccacatctagtggataggtatctgtcatcacgtcattgtcgtagaagtattcatcggccagtccgccaaagctatgcccgaactcatgtaccacaacggggcggaacatgggatggtgggcggtagtaagggtataggaattatagattccaccgcctccgtattcttccgtattggcaaggatgatgatgtgttcatacggtattcccgccagcgcatcgtgtatggatttgacacgggaggttgtcagataccggtctgaatagaatgtgctgaaatgagagctgaatgctgtccgtttccattctccgaggcgtggtacgcttactccgctgtcttcggaggggctggccactgctacaatgttgaagtgctttttcatggaccggaagggttcgtgggcaaacagactttcgcaggcaatggctgcgtcttcgtagaataccggcatctcttcgggagtatatccttctgcaaggatggctacgtcgatgcatttggccgtattgccgctttgcagcagatatttatgtggtgtgatgtgggcagtacctttctgatgtatcaggatgtcgtcgggactgaccgtatgtttcatgcttgcccgtacatttctacgcgggtcgagaagtgttatttctatttctgcaggacggaggggatagggaaggagaaaggtgttttcgaatcctttggtcaccgctttggcttcatccgtttccagccactcctggaagagcgaagaaaaggatgttttgtagattacgctgccattggctgcatctcgcataatgatttgtccgtttccttgcaggggcaactcagataaatgatgcttccttcctgcccaagaggggagacaagacaatccgtccaggcatatctcttgtttggctgcatttccggtaaagatatagtcgacacgcagggttttatctgcaaaataatctgcaaaactttgggcatgcaaggatattgctgccatcaggcataataggaataaggaatactttttcataacggttcattattattgctactacaaagataatatctttaaagctcatctgcaattttccggtcgtgcgagatggaattttgcatatgcactttgaaatgcctgatatgcggtattattcttttttttgtaagaaaagttataaaccgtatttttattggcgaaaaaatagctaactttgcatgttgccgtatagatatgcggggagatatagtaatttattaatcattagaatttgaaatgggacatcatcagttggatactttagacgaacagattttaaaacttatagccgataatgcacgcattcctttccttgaagtggccagagcttgtaatgtatcgggagcagccattcatcagcgcattcaaaagctgacaaacttaggtatattgaaaggttctgaatatgtgattgatccggagaagataggatatgaaacatgcgcctatatcggtatctatctaaaggatcctgcttcttttgatgctgtaacgagagcattggaagctattcccgagattgtggaatgccattttacaacgggcaagtatgatatgttcataaagctttatgcccgcaacaaccatcatttgctgagcatcatacatgataagttgcagccgctgggactggcgcgtacggaaaccttgatttctttccacgaagccatcaagcggcagatgcctataacggtagaagaagaggaagattaattctaccggcggatataatcgacgaatgcataagggcagggatgcttctcatctgcgggatgggactccctgcttttttcttgccatacagtcggagcgacttcgggaaagtaggcatccacctgaggggcttctgcatccacctcggtcaggcagagggcacctgcaaaggggagtgcctggcgataaacgcttgcaccgccgatgatgtagacgtgttcgtcgggctggcaactgttcagtgcttcttccagtgaggaaaaaacttctgcatcgggacaaatcaaatctttttgagtggacagaacaacgttgcggcggttgggaagcgcgcctttggggagagattcaaaggtctttcggcccatgatgatggtatttcccgtggtgagggctttgaaacgcttcaaatcattgggaagccagaataacaaccggttctgataaccgatacctctttttctatctactgcggcgataatactaatcatatgtgtgtaaaattcttttctctttctatctttttattgtaggatttatactgacactttccctgcaatatgcggatgcgggttatagttgaccaactcaaaatcctcgaacttgaaatcgaagatgtttttcacatccggattgattctcatctgcggcaaatcccgcggttcacgagatagttggagctttacctgctccagatggttcagatagatgtgggcgtctcctaaggtatggatgaaatctccggctttcagtccggtgacttgcgccatcatctgcaggagcagggcataggaagcaatgttgaagggcactcctaaaaaaatgtccgcactacgctggtacagttgcaggctcagccgtccgttggcgacatagaactggaagaaagcgtggcagggagggaggttcatgttgtccaaatcgcctacattccatgcgctgactataatccggcgtgagtcgggattgtgcttgatggtttctacagcttcgctgatttggtcgatgaatccacctttatagttcggccaggagcgccattgatacccgtagatatgtcccaggtcaccgttttcgtccgcccattcgttccagatgcgtacaccgttgtcctgaagatatttcacattggtgtctccttggaggaaccatagcagttcgtatatgattgatttcagatgcagcttcttggtagtaaggcaggggaagccttcatccatgttgaaacgcatctggtggccgaatacgctgatggtgccggtacccgtacggtcgcttttctctacgccttcggtcagtacgcggttcagcaggtctaaatattgtttcatgatgtagctctgtttttatccgaacgcaaaggtaggggaattaattaataattaataattaataattaaaaattagaggaagggggtcatcaagttccccacccagcctacgaatttcttccatccggaacgctttttccagacttcgggagtgagcagtgtactgttttgcacgtcccgttcgaacatggcattcagctcattggtgatcttggggtcgaagatgaaagcgtttgtctcgtagtcatagcgcaggctgcggctgttgagattggcagtacccaccgtgcagaaagtgctgtctaccatcattatcttggaatggtggaagccgccgttgaagagatatatcttggctcctttcttcatcagcttgtgtgctatgtagaatgaggcatccggagtaaaggctatgtccgacacggcaggtatcatgatttccacttcagtaccttttttcagtgcgttcttgattgccttgcggattgatttggtcggaacgaaataaggattcacgattcggatgctcttctgtgcggcttgtatggaagctgcataggcatggctgatggagcgtggtgtttcgcgtggcgtgcggtccacgatggctatttcttcggcaatactgtcgggcagttgctgagtatccgggaagtaggcaggtccacctacgtgttgtcccgtttcccggttccacatggtcaggaagatgccctgcagatagcgcacggcatctccttcaagatgtatgtgcatatcgtgccatttaccgattttaggcaatccgttgatgtagtagtcggcaatgttcatgccgccggtataacctatctttccgtcaatcactactattttccgatggtcgcggtgtatggcatgattcacccagggaaaagtgataggatcgaacttaacgatttcgatgccttgggcgcggatggatttcagatggcgttctttcaatggttggttgttggaccagttgccgaaggcatcgaacatggcgcggacttcaactccctccttgactttctctgccagaaggctgaacaaggcattggctatggagtcgttgcggaagttgaagtattccaaatggatatgatgccgggcatggcggatattctcgaagagatcgacgaacttgtcatggccggtcatcagcaatttcacttcattgttataagtgacgggggcgcccatttccttcaagtaattcatgacaatggaatcgcttgttgcttgcgccccggcattcccaatagaaaaaacgaataatatgatgaatagaatctttctcaaaactttctcctcttagttagttttatgaggggacaaagatacgatttatcattgaaaaacaactatgccatagatgaaatcttgcggtaaccgaaatagagcaataccactccggcaatgattaacgacttggggtcaagctccgaagctccgctccggatggcagtatcgaaggtttcgcgcaaggtgtccagtatcagctgcactccgtcgagggagacgaacagtacgagggccagagtaaagcagaatgctgtccatatctgcgccaagtggcggctacggtcgggcagatgtcgcagtacgcggcggctgaacccgttatcggctatttcctgccggtgttcggcaaagaatgaagtcaggagtttatcatcattttccatcataaccattttgttttaagtaggaagccattttgtctttcgcccgcgagaggtggctttttaccgttcccgccggacatccggtgatacctgcaatcttttcgatgctttggtcttccatgtagaagagcgtgatgcaggtgcgttccatttccttcagtgtggccagggcacggtaaatgtccatgtgctgtcccacgtcctgctgcagtgtgctgcattgagcgtccactcggtacgtatccaaatcgtccgtttctttccggctgcgaatataatcataaaaaacgttataggcaatacggtagagccaggttgagaagctggacagattcttgaacgaagcgatgtttgtataggccttgataaacgtatcttgtgccaggtcgtcactcaactcgctgtcgccgcaggtctggtgcaggaagaaccgccgcacgggcgactggtacttctttaccaactggtcgaaggccctggtgttgtgaaacaccacgacctgtgcgactaacgatatgtcacccatctgactcatttttcttcgttcttcttctgttggctgtagaaaatcaccaattgtccgaagccggtgaacatgacgagtaagccgatacatccgagaccgaattctccggtaatggcccaaaggaagatgaacaggccgatgccgacgaatatgttgttgatgcctttgctgcggatatccgttgctgcggcttctttgaagaagttttcaggcagttgctgtccgctggccagggcctgttccgccaggcggtacttggctttccggtttttatagcggaagaagaatactacgaatatgatgagtagcggcagtccgaatacaaagacgatggctgttacggcaatcacggtctccgaggtcttgctcccgaggtcgaacccgttccagtccatactgctgtggtgggttctccatttttccggagcatcgctactgccggtaccgttttcataagtcatgatgctgagtgtgtctgttacggtttctccattgatgacagtgtctctcaattcgatgactcttttcttgttcccctgaccgtcgttctctgttacggttctgtttgcgccttgcaccagtgtgcagaacatcatggcgagcattaatccaaaaatgatacgtttcataatctatggtcttttaatttgtttctttgttggttagacgtgtcgtcacctttataaagttgcaaagagaagatattttttttagaaaaccggaaataaggcgatatttttccgtgaaaatgtcttattgtcttttttccggaataacaagaagtaggtatttgcgactgtaaatagaggtaaatatacaaaccgggttgtttcttattgtaaatactgttatctttgcgcatctgtttttattgggaagtcttgatgaagttgaggaatataatgaagtgtttcctccctctgctgttcattgcctatctgggaggaattacgctgtttacccactcgcatgtggtgaatggtgttatcattgtgcattcccatccattcaagggccagcatgagcatacagaggtgcagttggaaaccattttctatctagcctctttcgtctcttcttcccttccgttgcttccggttgccgcgacggttttccttgttttgttgtgtgtactgagcattcttaccacggaatgcatcaagtgtgtaaagcttcgtggcggtatttgcctgcgtgctcccccttctttttttcaaatccgatagattaaggcaattccgttgtgggattgcgtcaacctcattgattaacatattattttagaagtacatgaaaaaatatatattttttgtggtgggagcagtatgtctgttactctcatcaaccgtttatgccgaagatttgaagagtaccgatgccaatattgtcggtcatgtaatagaaaaaagtacaagggaacatttgccttatatgacagtttcgctgaaaggcaccaccatcgggaccatgaccgatgccaccggtcactatttcctaaagaatctgcctgaaggtgagttcacgttgtccgtcagtgccgtaggttataagtcgcaggagcgcaaagtcgttctgaaacgtggtaagaccttggaagagaactttgagttggaagaagacatggtggcactggacggggtggtagtcacagccaaccgcaatgagactgcccggcgcttggcacccactttggtcaaagtggtcactcctaaactgtttgagcagacaaactcgcatactttgtcgcaaggactggcctttcagccaggtgtgcgggtggagaccgattgccagaattgcggttattcacaagtgcgcatcaacgggctggatgggaaatatacccaaatattgatagactcacgtcccatcttttcctctctggccggtgtgtatgggttggaacagattcccgccaacatgatagagcgtgtggaagtggtgcgtggaggtggttcagccttgttcggttcttcggccattgccgggacggtgaatatcattacgaaggaaccgattcgcaattccggttctttctcgcataccatttccaatttcgacggttccggctcgttcgacaacaacacgaccctgaatctttccttggtttcttcggacagtaagatgggggcttatgtgtacggccagagcaggcatcgttcggcatgggactccaacggagacggtttttccgaattaccgaagctgaagaaccagactgtcggtctgaatgcttactaccggacaagtgcctattccaagctgagccttgaataccatcatatggaggaattccgccgtggtggaagtggcttcagccttccccctcatatagccgaggatgccggattgaacggtaccggggcgcccggactggtggaacagctgaaacattccatcaacacgggtgggctcaagttcacggctttctccaaaaaccagaaacatacgttcagtacctatgcttcggctcagcacatcgtgcgcaatagttattacagcgcttatggaatgactacggactttaccggtgtgctgggtgcccagtatatttatcattttgacaagtgtctgtttatgcctgccgatttgaccggaggcattgagttcaatcacgacaatctgcatgacaaggcaacggacgtacagaagtatcgtgatgctgctttggccgaagatcctacggcaacgggtgaccgcttgcaacaactgattgagaaatatacccccgccccgttgaaccaagtggtgaatatagcaagcgtctatgcccagaatgagtggaagaacgaacagtggagtttcctgattggcgggcgcgtagataaaaacagcatcatggacaaggctgttttcagtccccgtgccaatatccgttacaatcctactcaggatgtgaatatccgtttcagttatgctgagggattccgtgctccacaagcgtttgatgaagatctgcatatcagtaatgtgggtggagagttggtttccattgtccgcgccaaaggattgaaggaagagcgttcgcgcagcttcaatgcttcggtagattggtaccactatttcggagatttccaggcaaacctactggtggaaggcttctacacgaaactttccgacccgtttgtcctgacgcctccggtgaaagacccggatggtagcgcttatctgatacagacccgtatcaatggttcgggagctaaagtgtatggcggcacattggaaggaaaggttgcctataaggataaggttcagttgcaggcagggctgacgcttcaacgaagtatctatgactctcccgaagaatggagtgcggatgaggagcacttgtcggagaaagaacgttacagcgacaagatactgcgtactcccgacgtctacggctactttacagctacctatatgccggttaaagccttctcaatagctttgaacggcaattataccgggcggatgtacgttccccatttgctttcggaggtgaacggtgaggcggatgtattggtaaagagtccggacttctttgagcttggaacaaagatagcttacgactttgattttcaagggttctgtttgcagctcaatgccggtgtacagaatatattcaattcttatcagaaagattttgataaaggagcgagccgcgattccggttatatctacggaccgggtgcaccgcgttcctattttgcaggggtgaaactcagtttttaaaaagagtattgaaccgtgctttttgtttagccccgtagattggtgaaacgtattttgcactatctttgctgccataaaacagttcaaagcatgaagctaccctcatctttcaccgattatacacgcgccctcttgggtgtggaagaatatgaaaagctggctgccgccctggaaggggagcagccggtcagtatccgactgaatgaagataaattaccggaatcttcattcagtctttttcgttcctcttttaggcatgtcccttggtctactgccggatactatctggacaagcggctgacattcacttttgacccgctgtttcatgcaggctgctactatgtgcaggaggcttcgtctatgtttgtggagcaggctttgaggcggtatgtgggcgaaggaccggtggtgatgcttgacctctgtgcggctcccggcgggaaatccacgcatgcccgtagcgtgttgcccgcaggcagtctgctggtggccaatgaggtaatccgcaaccgctcgcaggtattggcggagaatcttacgaagtgggggcattccggtgtggtggtcactaataatgacccggcagatttttcttccttgacggacttcttcgacgtcatattgacggatgtcccctgctctggcgaggggatgttccgtaaagaccccgttgcggtaagtgagtggagtggggagaatgtggaaatctgctggcagcgccagcgtcgcatcgttacggatatctggccttgcttgaagtccggaggcattctcatctacagtacttgtacctataatacaaaggaaaacgaagagaacatccgttggatacgggatgaattcggggcggaggtattgccgttggaaatttctactgactggaatattacgggtaatctattgtcgggagaggactttcccgcctatcgtttcctgccccatcggacgaagggggaaggattctttttggcagttctccgcaaaccgggcgtgagcgatgggaatacctgggccgggcaggtgaaatcctgggaaaaaggaagaaaacctcaaggaaaaggagcgaaaactccgggtgtttccaaagaacagctttcggcactgcatgagtggtttgcggttccggataattacgaatttatcgtcaatggcaacaacgtcagcgctttccctaaagcgtatctctccgaactgtcggctttgcgttcgtcactccgtatcgtgcaggctggggtagatgttgccgagttgaaaggaaaagactggatgcctgctcatgggctcgccatgagtatagcactgaatccggatgcctttgcccatgaagagataggccgcgagcaggccatcagctatctgcgcaaggaggctgttgtcctttcggagactgctccgcgcggcattgtcttgctcacctacaaacagatacctctaggatttgtcaagaatataggtaaccgtgccaataatctttatccccaggaatggcgcatacgcagcggatatttgccggaaggggtgctggaattggcaacaataaccgggtgaaatcaatcacgttactgcaaagctgctgtatatattttgcagtagcactgcagagctgttgcagtgacactgcaaatatatatgcagcgcgactgcaacacatatgcagtggtgctgcaacacatatgcagtgcgactgcaaaaaatatgcagaactttgcagtatgataatagagtaggaatgtactattttttattgtttcttcaatgcagtattttgtttgttcaagcattttctatatatagataactgttttaaaactaatactatttgcttatgcttaaaaaaacgattactgccttaagcctactttgtatccttgcagcctgccagagtgacgacaactcttcaccacaacccaagcctcgcaaagacattgccttgacccgtgccgagcaggagatgatggatttaggaacggatttcgctttccgtttctttaatcaggtttgtaaaactgaggtggaaaagcccaatctgttcatctctcctttgagcgcttcgctctgtctgtctatgattgccaatggagcgttgggaaacacactatctgagatgacagatgtcctgggcttttcgggctattcgttggaagaaatgaacaactataataagaagctggtggaggcgttgctcgatttggacaataccacacagttgggaattgccaattccatctggataaagaaagggttcggtgttcatgacgactttgtaagcgtaaacaaaaagatgtatgacgcgcaagtgcaggagctggattttgcctctcccaaggctccggacattataaacggctggtgtgccgggaaaacgaataattgcatccccaaagtcttgaatgagattccggagacggcgcgtctttatctgttgaatgcgctttatttcaaggggatttggaagaatcaattcaaaaaatcggatacggcagaagaggcttttacgaatgctgacggaagcaaatcgactgtacacatgatgaatcttcgtgacgagagattcaactatgccgagaatgagtatttctcaatggcagagttgccttacggcaatgaggctttcagtatggtggtgctcttgccggcagagggaaaatcgttggatgagtgcctgccgcagctgaatgacgagcgctggggggaatggaacagtagtttatcaagctctgccttgaaccttaagttaccccggtttgaaatggaatatgataaagaactcattgacgatatgatggcaatgggaatgcaggaggcttttactccatcggccgatttttccggaatggcggatgaggatttgtttatcagtttgctgcaacagttcacttatgtgaaagtgaatgaagaggggacggaagctgcggctgtaactgtcggaggaatggacgtggccgctcccggaccaagtacggtaattccgttctatgtggaccgtcctttcatctttctgataaaggagaagagtacgggagttattctgtttatgggtaaagtcacaaaactataactacaatatattgaaatagaaagagctgtctgtcaaccgcagacagctctttctatttataaccggctcttgtatatctgtgccattgccttctgatactggttttccagttgcaggaggtttgtcttgctttgatagacaaccgatatttcaacgaagtattcaattatactgatttgtcctcccataagtgcttgtttcagtaaagaaaggtcttgctgttgatggaaggtgcgctcgtattcctccatggaagcgtgcaggttcttggcctcttcatagagttgccacaaggcagagctggcttgcagtgcggcgttctccttttggtagtcaatgttgagcgcttgtgtcttggctatcttgaccttattgcggttttcgaaaagcgggaaagagaagcctactactacaccgtttagcggatgccccgattcggtatttctacggtaacccagttccagtttgggcagccagccttgcttgcttgccgaaatctgtttccgggcggcagaactttcaccctgcaaggattgcagggtggggtctgaagccagcagttcgtcggccagcgggtggaagtcggccggcaacggcactgccgggtattctgtcaatccgagtgtttgggcgtcgggtgtggtatcgggtctgggacgtcccggtgtgagcggctggtttccgttgaggacaagcagctctttcagtttattgttaagtgccgtctggttcatgcgggcttccgtgcgtacattcagcaactccagattaatcttgttggtttccagtgcattggcatctcccgtttccaaacgccgggtgtacatggccgacagttcctccgcattcttcaaccgttcgtcgagcagggcttgctggcgttgcagcatgatgatgtccaagcatacttccttcgcttgcaacaatatctgctggcggaaggcggtggcttgtgcatccagtgcatttgtcttgagtcggttcatcttccctcgggtggcgtaaagcgtggggaagtcgaagctttgcgagatgaccatttcgccgactgtctcgtcactgttcttggagtcccaaaggtgggcgtatgacagtgtagggtcggggaggttgttgtttgtcttgttctccagtttttgtgaggaaatgaggtgggagttagcctgcaattccttgttgttggcctctatctgctggagcacggcatcaatgccggacgtttgtgcgctcatccccgcaaaagcgaggatggcggcgctgaatatgaaaaatcttttattcattgtctgacgttttaggttgttggttatggtgcatcatcaggtaaacaatcggaatgatgaaaccgttcaggaacgtggatgttaaaaggccgcccaagataacctttgccatcgggctttgtatctcgttgcccggcaggtcgccactgagagccagcgggataagtgccagtgcactggatagggcggtcatcaggattggattcagacggtcgagcgaaccgcggataacgctgtcgtagacgccatagccttcttcctgctgcaagtggttgtaatggctgatgagcagcattccgtttcgggtggcgataccgaacagtgagatgaaaccgatgatggcggggatactcacttctcccgttgtgatgagcagggcgaatacaccgcctatcaatgccagcggcagattgataaggatgatggcactctccttcacactgcggaattcatggtagaggagcaggaatatcaccacgatggacatgaacgaagtaagtgccagcgtgcggcttgctgcctgctcgctttcgaattgtccgccgtattcgatgtggtatccttccggcagtttgatttgtgcgtctacctgggcttgtatatcattgactacacttcgcaggtcgcggtcggccacgttggcggagatgacgattttacgctttacattctcgcggctgatggtgttcggacccatggccgagcggatttccgctacatagttcagtggaattttctgtccgtcgcccgtatcaatcatcaagttgcgtattttttccatttcgtcgcgtaggttgtctttcacgcgtacggtcaggtcgaagctctttcccttttcgtaaacttgggaaacggcttcaccggccaggcagacattgacaaactccgaaaattcgggcagtgaaatgccgtatttggcaagcatttcccgtttgggtgaaatgacaagttgcggacgctcaatctgctgttccacgttcaggtcggcaataccgggaatcccctggatggcactcttgatttcattgcccagagtgaacatgcggttcaggtcgtcgccgaacagtttgatggcgatgttcgcctttgtaccggatagcatggcgtctatacggtggctgataggctggcctatttccacgtttgcccctacaatggtacccagtttttcgcggacttctgccacgagctcgctgcgcgagcggtctttcaactcaaacggtgcctcgatctcagagacgtttactcccagagcgtgttcgtccagctctgcacgtcccgttttacgggccacggtctgtatttcggggatggaaagcagcagctcctcggcacggtgccccatcttgtcgctttcttccagggaaatgcctggaagcgaggagatattgatggtgaacgaaccttcattgaaaggcggcaggaacgagcggcccagggtgaagaaacagccgagcgctactacaaatagtccgatagtacctcccagtacccctttcttatgccccaatacgaaagtcagtgcagaaccataccattgcttcatcttgcgtgctacggcagaatcgctgttttcgttgttttgttttttcgttttctcttttcccaatagataggagcaaagtaccggcgttacggtcagtgccacaacagttgaagccgccaatgccacaatgaacgcaatacccagtggtaccaacatcctaccttccataccactaaggaagaacagtggtacgaagctgacaatgataatcagcgttgaattgaggataggcatacgcacttctttcgaagcattgaacaccacttccagaataggaagttgctcgccggcaggtttcagtcggttttcgtgcaaacgcttgtagacattctccacgtccacgatggcatcatccaccagcgaaccgatggcgatagccatacctcccaggctcatggtatttatcgtaaagcccatatagtgcagggcaaagatggaggcaatcagtgacaacggcagtgtcaccagcgagatgactgtggtacgtatgttggcaaggaacaggaaaagcacgatgacaacgaaaatacctccctccaacaacgacttctgaacgtttccgatggaactttcgatgaaacggctttgacggaagatgtctgtggaaacctttacgtccgccggtagattcttctgcaggtcttgcagggaagcttccagtttgtctgtaagctccagcgtgcttgtggcgggttgcttggtgactgtcagcagtacggcatgcttaccgcgttccgaggcggtacccagtttaggaagtttggctccgacttgaacgtcggcaatatcttccagcaggataggggcgccggagactccgttgctccgcaccacggccttggctatctggtctaccttgtcggtagaaagtacgccgcgtacgatatattcattgccatattcatagagcactccaccattggcattcaggttcatttcgcgggtgatgttcatcacttcgctcaatgttacgccgtaatggcgcatccgttccgggtccagctgcacttgatattccttgatgtcgccacccagtacggcaacttgtgccacaccgcccgtagagagcaggcggggacgtatggtccagtcggcaatggtacgcaaatccagcatagaggtcgaatctgctgtcagacctacaatcaacatctcgcccaaaatggacgattgtgggcctagtgtcggcttgcctacgttggccggtaaggattcgctgacgactgccagcttctcactgacaatctgccgggcaagatagatatctgtatcccagtcgaattctacccagactacagaaaaaccgttcgttgaggaagagcgtacacggcgcacacccgttgcaccgtttacagccgtttctacgggaaaagtgaccagctgttccacttcctctgctgccataccatttgcttcggtcatgatgaccacggtcggcgcattgaggtcagggaacacatccacttccgtatgcatggcggtataagtaccgccaatcagcaacagcaccgatgctaccagcaccaggatgcggttctgaagagaaaaaccaattattttgtttaacatctttttatttactatttacaatgtacaattgggctgcgcaatgtcagccgcacttgctgttttatctaatatttcttgtttatctgactttacactccccattcgtcacgtaacccttatactgcatagcgaaatggtactttgtaaattgtcaaattgtacatgagattagtgttcatggctatgtgccggaatagcattcgttgccgatgccagcttcacttgataggctccttgggttacgacgcgatcgcctgcttttatgccggaaaggatttgtacactttcgccattgtcggcacccagggtgacaagctgttttttgtagccctcttcatccagttgcaggtagacaaagaagctgccttgttcctcggtcagcgcactgtgaggaagagacaacacgttctccattggtgaggataataggaatacttctacaaacgagccgggaataacgtctcccttattgtcgaattcaaaagttacgggtacataatatccgttctcacccgaagcctttccataagaaagcatgcgcccgcccagttctttcaatgtatataccttattattataaggagtacagaagttggcagaaccgatgctgtttaggtaaggatagtacttttcggatacatccgcacgcaggaaaagcttgcggttctgggtgacgcttaccaacggctggccgacgctgacgtagtccccttctttcaccaacagattcttcacataaccgctgatgggagaaacaacagcctggccgcttgccgaatggttctttgcgactgcctcgtaactgatacgggcattttcgtaaatctgttcagcttgcgcgaattccttttcagatacgattttgttgcctacaagcgctttcatacgctcgtattcttttttggaaacctcgtaggctatccgggctttctgcaccgggtctccgtcggccatgtttttggatgacaataccaccaaaggagtacctttgctgacactcattccttcgataacttttcccttgaaggaaaccacgcctgctactgtagctacggctacgctctcgtctccctgggctgccatcacctggccgctggtcttgatgacttgatggaaactacccggttcaacagtgctgactgctacgccggcagcttgcgcctttgctggtggcaggatgatttcatcgcttcctccggcatggttttcctgctcttcgtgctcatggttgtgtccctcatgttcgtggtcatgtccctcgtggtcatgtccgtcatgattgtgctcttctgtttcgtgattatgtccttcgtggctgtctccggacttactgttacaggagcctaaaaggaataatcccaagactcccatgaaaataacttttttcatgatgatatttgttcttactttttgattttgaatacaaagttagggcatagggcgtgcaaccaaattgcattgttccttatgccggatagaaatctgtcccggtgatgttccggtaacagttaagcaagaagagacggaggggcacgaagtcccgtagcacatatgataaatgtgctatgaagagattccagatagatacactcctgcctgcttatgtcaaactcgggtaggatgagtaacttggaaaaaggttcaatgagtagggtaactgcccacaaggcatccggatgtgaacacacatcattggaagagctgggcgtctgttgtacaaagtgggttgtcatgcatcccgtgtcgcaacagcagtgctcgttgcccgggctatgacggtgtccgcagcaatcggcggtgatatcattcttcatgcatatcattccgtcggcatgatgatggtggggaatgacgggtatcaccagcattatcaagctgatgaaaaaaagaatataggttatgtactgtttctttttcattcctctatctttggacggatgcaaagatagaggttaaggacttaattaccaaatagaaaatgctaaaaaggtttgaataacatattcaatccctcattcatgctggggtgggtgaaaatgaagtcccgcaggaaatggtaacgctgtcccgttttcatgattgatgctacggtattgattacttctggtgcatcggcacaaagtagggtacaacccagaatccgtccggtatggatgtctacaatagctttgagcataccgtctatgctgtgtagcgtacgggcacgtggaatcatggcagcagggatacgtgccacatgtatggaataaccgttcttcatcgcttcctcttccgtcagtcctatatgtgccagcggtgggtcggtgaaaatggcaaaggggattggataccggtcttttgtactcctttttttgttttcaaagagttgattacggatgatacggaaatcatcgatggacaagtagtcgaactgttcgtctccttttacgtcccccagggcccatacgtgtggggctgtagtccgtaattggttgtcgacaacgatggctccccgcttgtctgtttgtatacccgctttttccagattcagctctgcagtcataggcttgcgaccgatggctaccagcaaggcatctcctttcaggtagtagggagtgccgtttgcactgtccgtataggtcagagttattccttcggctgtgtcgtacacggattggacacgggcgttcaaccggacattgatacgttttcggttcaatgcttccagcatggaggcggcaatgtcgcggtccactttaggcagaaagcggtttcccgcttccagcagtgtgacatggcttccaaagcctgcatacatagtggcaaactccaatccgacagcaccgccgccgatgacgagcaggtgtgcgggcagtttgttcgattgcagcaaggtctcactggtatatacgtacttgctctccttgagtccgtcgatggcaggcaggataggggtggacccggtgttgatgaatatctcttttccctcaagaatcgtttcgtccttgccggagactatacggattgtattttcggacaagaaagaagcagttccgtcatagagggttatattaggcttgttttttacattttcataatttttctcacgcaggaaggatacaagcttgtctttccgcgccacggcaagtgcatacagtttggactggttcttataatcgtcatagtatcttttttccgcatattccgattcgtgaatcagagctttggtagggatacatcctacgtttacacatgttcctccgtacatctgaggggaacgttccacgatggctactttccaattccgttcggccagttcggcggccaataacttgccgcccttgccgaatcctattatgatggcatcatattgtttcattttaatatctcttagttaagtgtttagtaaaatgaaaacaatatgtatcggccatttgttcggacgccgggtttagcagatgcttatcgttccagttcgcggagggagtccattttcttcttttcaaggaattcgtagatgccgctcaagtgctctttcacttgtttgttgccgaattcatataccttgcttaccagtccgtccaggaagtcacggtcgtggctgacgaggataagggtaccgtcaaaatccagtaacgcttgcttcaggatatctttggttttcatgtccagatggttggtcggttcgtccagtatcagcagattcaccggttcgagcaaaagctttatcatggcgaggcgcatgcgctctccaccggaaagcaccttgaccttcttcatggactcttcggggccaccgaacatgaaggcacccagcaggtcgcgtatcttgttgcggatttccccttttgccacatcgtcgatggtctggaatacggtcaggttctcatccaacaatgaggcctggttttgtgcgaaatatccaatctgcacgttgtgtcctatcgtgagggtgccttcatgttctatttccttcatgatgcacttcactaacgttgactttccttcaccgttcttaccaacgaaagcaaccttgtctccccgttctatggtgaggttggcattcttgaagaccacatggtcaccgtaacttttccctactccctccatgatgacgggataattgcctgagcggggagaaggagggaatttgaggcgtaacgctgaagtgtcttcttcatccacttccagcagttccagcttctccagcatttttacgcggctttgcacttgcagggttttggagtaggtgcctttgaaccgttcgatgaattccttggtttcggcaatgaacttctgctggtcgtcgtaggctttctgttgctgttcgcggcgttccttgcggagttccaggtatttggagtagtttactttgtaatcgtatatccgtcccatggtcacttcaatggtacgggtggtgatgttgtctacgaatttacggtcgtggctgatgacgatgacagcctttccattgctgataaggaaatcttccagccattgtatggattctatgtccagatggttggtaggctcgtctagcaacagcacgtcaggcttttgcagcaacagcttggcaagctcgatgcgcatgcgccatccgccgctgaagtcactggtctggcggttgaagtcttcgcgtacaaagcccagtccgagcagtgctttttccacatcctcctcgtaattggtggagtcgatggcatagaacttttcgcttaaggcggagacattctcgataagttccatgtagctgtcgctttcgtagtcggtacgcgtttccagttccttgttgaggcgctctatttcagcttccatttcatgcaggtgggcaaaggcttgcgccgcttcctggaatacggtacgtccgtcttccgtcataaggtgctgtggaaggtaagctatgacactgtccttgggggctgagatttttccacgggtaggttgtcttacacctgccaggattttcaacaatgtacttttccccgctccatttttacccatcagggcgatacggtctttttcgttgataacgaaagatatgtcactgaataaagtagttccgccgaattctacggccagtccgtctatagaaatcattatatatttttttaatgagctgcaaagatagtgcaaatctattattttttatatctttgcccctatataaacaaaacgcataggtcatggaaatagaaaaagtgtcaggagattaccgtccgcttattctggttgcggaagatgatgatagtaactttaaactgataaaggctattatcggcaagaaatgcgagatactatgggcaaagaatggtgaggatattgtaaatttgttcgaagagaatcgcgacaaggcggaagctattctgatggatataaaaatgcctattatgaacgggctggatgctacggtgattattcgcaagaaggataaggaacttcccatcatcatgcagaccgcttacgcctttactgccgaccgcgaaaaagccttggagtgcggagcctcggaagtgttggtaaaacccatcactctgtctgctttgcgtacatgtctgagccgttatttacctaaattagtttggtaaggctttactgataataaaaagggaaccggatgactaagtaatgaatatatcatccggtttccttctttttattcttgtgcattgtcttttctctcttccatcttcttttttacaaattcgattttgagattggcttcttccatattcttctttatttccgtcatggatgacagcagttgtgccagttcgtagacgctggcaagggcctggcggtcggcggcagtcatggtgatggaatagggacgttccccttgatagttgactttgatattcttgtccttgttcagataaaggaaccccatgacgtttccgtcttctcccagtttgaagtctgccttttcaatcttttcaccgaggtcagtggtttcgtagctgtctttggcggcgggtgtttcggcaaagctaccatcgggagcagtgactttgacggccacatggtggatattatgggctccgcaataaatggaagtcatgctcatgactccgttttcgtctacctggaagcgaaggaaagagcgatgcagatttttttctatcacttgggaaggatgaaggtaattgccgatattctggtattcggcatctttttcaaaggtgtatttccctttgattgcatcgaaatccttttgcttggcttgaagcatactgtccagatagaccaggctcttttcctgctctttcagttccacttcctgcatcaggccgatgcctgcacggcgagtttcaaacgctttgggatagagcatcttgatgctgtcaatcagaatcttcgcttcattgtagttgccgagttcaaacgcttcgcgggcagcttgtagtttttcaccggccttcttctccacatcttcgcaagagaagagtgtacagcataggcatgcaaggagtattacttttttcatatttgttgttcttggagttagagtccacaaaaatagaaataatatctttatctttgcagcattttaatgtgcaaatgtgctaatagaccattaacacatttgcgtattcattacattagcgcattatttatgatagatttgacggcagaagaactgaagcaatattttagtgatgatatattcaagcggatatccgaaacggctgatgaattgggattggaatgttacgtagtcggtggatatgtacgtgatattttcctgcaacgtccttccaaggatattgatgtggtggtggtaggcagtggcattgccatggccgaggcgctgggtaagcgtctggggcgtggggcgcatgtttccgtcttcaagaatttcggtacggcacaattgaagtactatggtacggaagttgagtttgtgggtgcaagaaaagaatcgtatacacacgattcccgcaagcctattgtagaggacggtacattggaggatgaccagaaccgccgtgattttaccatcaatgcactggctgtttgcctgaaccgggtgcgttatggcgagttggtcgacccctttggcggtattggagacttgaaggaaaagaccatccggactcccctcgaccctgatataactttcagtgatgaccctttgcgcatgatgcgctgtgtccgttttgccacccagctgggattctatattgacgatgagacattcgattctctggagcgtaatcgcgaacgcatctccatcatctccaaagaacgcattgcagacgaactgaacaaaatcatcttgtcacctattccgtctaagggattcattgagctggaccgctgtggtctgctggaactgatattcccggaacttgttaggctgcaaggcgtggagacgcgcaatggacgcgcccataaggacaatttctaccatacgctcgaagtactcgacaacatcagcaagaagaccgacaacctttggctacgctgggcagctcttctgcatgatatagccaagcctgccaccaagcgttgggaaccccgtgcgggctggacgttccataaccataatttcattggcgagaagatgatacccgatattttccgcaagatgaagctccctatgaatgagaagatgaaatatgtgcagaaaatggtgagcctgcacatgcgtcccattgtgatagcggatgatgtagtgaccgactcggcagtgcgtcgtctcttgtttgaggcaggtgatgatatagacgacctgatgacactgtgcgaagccgacattacttccaagaatatggagcgtaaaaaacgcttccttaataattttcagttggtacgccagaagctgaaggatttggaggaacgcgaccgtatccgtaatttccagcctccggtcagtggtgaagaaatcatgaagactttcggcctttctccttgccagcaggtaggtgccttgaagagtgccattaaggatgccattttggacggcatcattcccaatgaatacgaagccgcccgtgcatttatgttgcaacgggcggagaagatggggcttaaggagttatgagttataagttgcatgttatgtaccatgcgttataactcataacttataactcttctttttctacttggaacttgcggcttactttcatcaggttgatggtgtaggtcactacgttctgggcttcttgtatcatagtcaggtataccatgctgactttgatgctgccgctctggctttggatgcgttgcagctcttcgcgtttcagatgagacaactgtccgttgaggtcgttggctttgcgaatctctgtttccagttcatcataattgttcgtttccagcttgtggcggcatacttgtaacagatagcagatgtcttcggctacgtctgtaaattctcctttctgaatggcatccagcggattgaagttattgtctatgtgctctaagcaaggttcgcaaagacggcctacgctgtacaccagttcgctggcaaagtcgttgccttgatagtaatagagtcctttttccaatacggtattgttgtcgagacggcacatggcaagtgttccggtacgcttcatctgcttgatgagttgtttttcgaattttactgagcccatggcacgacgcagtccgcgtagattctcgtgtaggaaggaagtgacggtacgttcaaaattctcttctgtgaattccataatcttcaccagttcttcacgggtatgcttgcggagcaattcgatgacttcattgttgtccgtactcttcatcaactgtttcagggtctcgttgcctttttctttctccttgcgctttttgtacatcacttggctacgaatcagcatgaaaactgccagaccaatcagtgccaggatggcaaccgtaccaccgaaatggataatcagtgctacgaagaaacagatggtgaacgctgctccggcagtgatgaaccaaccgccgataacgctgagcacacccgtaatgcggaataccgccgaatcacgtccccaggcacggtcggcaagcgatgtacccatggctaccataaaggtgacgtaagtggtggaaaggggaagtttcaaggaagttcccaaggcgatgagcagaccagccaatacgagattgacggaggcgcgaaccaagtcaaaagcggcgccgtcggctatgatggcttcatccttctggaagcgtgtgttcatccaccgcttgctgctttcgggcatcgttttggatattccgttagccagggtcatgctgaagcgtaccagcgtgcgggctatcggggtacttccgaagttctcttcaccgtcatcctggcgggcaaggtccacggaagtcttgatgacattgtgggctttcttggatgtgcagagtgcatagaccatgatagcgcctgcaccgataaggaaataccacggggttttggctgcaccgaggagtgaggacatcaggaatccgtcggggccggcggccgtaccattggctgtatagtcaataaatgaggaatatcctgcgagggggacaccgataaagttcaccaagtcattgccggcaaaggcaagagcgagggcgaaagtacccatcagaaccactactttgaagacatttatcttgcaccaatgcagtatctgcatcagtatggtgaagaatacaaagaaaccggttatcagcaatgcggtattgtcgtgtatccattgcttgttttcaggggtcatgaatgagctgtctttcagcccctttatcagcatgaagtagatgatgctggtggcagctataccaccgaatagcgcgatgctgtatttcatgttcttcttgtagttgaaggtgaacacgatacgtgccagccactgtaccagcataccgaagaagaaggcaatggctacggatacaaaaatggccatgatgacagagagtgccttgtctgtattgatgaggtcgcccagtcccaatgtatcgctgttatagaccttgatgagcgccagtgcgaacgtacctcccaacagttcgaacaccatggatacagtggtggaggtaggcattcccatagtgttgaagacatctaatagcacgacgtctgtcaacatgacggcaagcagaatgcacatgatttcggcaaagtagaagtgctccggttgatagatgccgtgtcgtgcaatgtccatcatgccattgctgagtgccgcaccgatgaagacgccaatgcctgcaatgaacagtatggttttgaaagatgctgcctttgctccgacagccgactgaagaaaattgaccgcatcattactgacacctaccacgaggtcgaaaatcgcgagtacgaacagaaagatgacgatacccagataaattgtttccatagacatgtattttatttccggctgcaaaggaaagagtttggtgttgcagagaaatgtcatacatgttacagaaatgttacaaagcgattgacgattgataattgacgattgataattatcgttaatcgctaatccttaatcccttgtttcaagtattcgtaaaagctatattgcgaccgtaccttctccttttgcggtcgtgacgacttccagcggtttcgcaaccggtcgtccacgaagcaggctttccgtttgtccgacagttgtatggatagcatatcgatgagctcttgcttcaagtccgggtccagaatgggggtgacggcttcgatacggcggtacaagttacgccgcatccagtccggcgagccgaggaagagcttgggtgcgccgccgttgccgaagtaccacacacgggcatgttccagaaaggtatccacgatgcgtgtcacgcggatgttgtggctgtactcctgcccggggatgaggcagcagatgccgcggacaatgaggtctatctctacaccggcttgcgaggcttcgtagaggcggtctatcatggcggggtcttgcagggcattcatttttaggataatccgtccttgcttgccttgccgggtcagttctatttcgtgattgatgaggcggttcagttcaggaatcaggttgaagcgggccacaagcaggcggtggaacaccggattttcctttccctgcagagtacggaacaagttgtgcaggtcgtttacaatcaccgggttgcaggtgaatagtccgctgtctgcatagagggtggcggtcttttcgttgaagttgccggtgctgatgtaggcgtagcttgtcagtttgcgcccttccttgtcgcggcgtagcacgagggctactttggcatgtacctttagtcctggtatgctgaaaatgatgttgatgccggcggctttcatcatctcggcggtggcgaggttgttttcttcgtcgaagcgggctttcagttccacaaagacggtgactttctttccgttctgtgcggcggctattagggtgttgatgacggtggagttctctgccacgcgatactgggtcaccatgatttcacgcacggtgggttcgtggacggcttcatatagaaaatggatgaagtggtcgaaggagtggtagggataatgcagcagcaggtccttcttctccacatagcggaagatggattcgcgttcgtccaggcaggtcagcttcatgggctggggtttcttgatgggacgtacgctttggttgggattaggcagatgccgcaaatcctccatgttgaggtgcttgtctcccggcaccagctcccggcggtctatgcggtaggcatctaccagaaagtcgaggaagtcctggggcatggcgcggtcgtatacaaaacggcacacggcgcctatcttgcgtttctttaccttcttcttcacctgctcgatgatttcggaggtattggcggcatcgtctatcagaatatccgcatcgcgtgaaatcttgatgcaataactgctgtccacttcataaccggggaagatggtatccagattggccttgatgatgtcttcaatgaacatcagataatagtctttccccaccttgggcagctggatgaagcgcggcactttgctgtacggcagtttcatcacgaaatactggatgcggtttggagaactggcgggagctcctttcagatgaagccgtacggctagatagagacggttgtcgcgcaggaatgaaatcaccttgtccttgcttacgggcaccggggccagataggggaatatctcttcgcggaagaagctgcgcacaaaatcgcggtgaaacggttctacgttgcggctttgatagaatatgatgtgatgtttccgcagggcgggcagtatcttctgttcgtagatgcggatacgttcctccagttggcgattgacttcttggttgatttcatctaccagttcggcggcagactgcatagtctcttcatcgctttgcgaggctccggtggctatggccttatggtcggctacgcgtatcttgtagaattcttccagattggaagagtatatagaaataaagttgatgcgttcgtatagcggcaatgtctcgtcttccgcttccagcagtacgcggtagttgaaggaaagccagctgatgtcacgtttgaaatatctgttgtccatggtgttaaggtgttaatgtggcatattagcacattaccacattgtattcttcccaaatataattacctttgtcttaataaacaaaggaaagatgacaaaagttggtttattatcggatacgcatggctactgggatgaaaagtacctgcaatattttgagggctgtgacgaaatatggcatgccggtgacatcggttcgctggaagtggcacagaagctggcggctttccgtcccttccgtgccgtgtatggcaatattgacgggcaggagatacggcagctctatccgcagattctccgtttcacggtggatggggcggaggtgctgatgaagcatatcggcggttatcccggcaactacgacccttccatcaagggcagcattctggtgcgtcccccaaagctgttcatcagcgggcactcgcatatactgaaggtgaagtatgacaagacgttggatgtactccacatcaatccgggcgctgcgggcattcaaggtttccataaggtgcgtacgatggtacgctttgcggttgatgggggaacgtttaaagatttggaggtgatagaacttgctgaccgatgatgtagtttgtttattttcaatggattgtatttaccgattgcttgcgctatagtgtaaaagccgttacatgctaatgtaaaggttgttacgctattgggtaaaggccgttacactatttggtaaaggtcgttacacgctgaggtaaagaccgtttcatcaaggggtgacggccgttacgcactgaagtaagcaaaacaatgtaccggagtaagcaaagcaatgaagtaaaaagatgaaaccaagccttcacttaatcgaatttttccattatctttgtacccgaatagcaagtagagccgtggggcatcgtcctccttcttattttattctccattttgaagtatcaccgaaaaagaactgaaatatgaaaggaattattcttgcaggtggcagtgccactcgtctctatccgttgtccaaggctatctccaagcagataatgcccgtctacgacaagccgatgatatactacccgctctctacactgatgttggcgggaattcgcgaagtgcttattatctctactccacgtgacttacccatgttccgcgagctgctgggaaccggtgaagaactcggtatgtccttttcctataagatacaagagaatcccaacggactggcacaagcctttgtgctgggtgcagagttcttggacggcggaccgggctgccttattctgggcgacaacatgttctacggtcaaggcttctccgccatgctgaagcgtgccgcttccatagacaagggtgcctgcatctttggttattacgtcaaggacccccgtgcctacggtgtagtggagtttgatgccaacggcaaagccgtctcgctggaagaaaagcctgccaatcctaaaagcaactatgccgtccccggactgtacttctacgactccaccgtgacagagaaagccgcctccttgaagccctctgctcgcggcgaatacgaaattaccgacctcaaccgtctctatctggacgagggcacgctgaaagtggagctcttcggccgtggctttgcctggctcgacaccggcaattgcgacagcctgctggaagccagcaattttgtcgccaccatccagaaccgtcaaggcttccgcgtgagctgtatcgaagagattgcctggcgcaagggctggatagatgtagaccagctgtatcgcttgggtgaacagcttggcaagaccgaatatggcaaatacctgatggaactggctgaatcgaagcgatgaactctttgttccccaaaaagagaaggagaatagttctcctataaaggcccgctgactttaatttttaatttataatttttaattctcatgaagacttatctcgtaaccggtgccgccggttttatcggcgccaactatattaaatatatcctggcaaaacataatgatattaaagtggtgatactggatgccttgacctacgcaggcaatctgggcaccattgccaatgacattgacgatgaacgttgcttttttgtaaaaggtgacatctgcgaccgcgtgcttgccgacgaactgtttgccaagtataagttcgattacgtagtgaattttgctgccgagagccacgtagaccgtagcatagagaatccccagcttttcctgatgaccaacatcctgggtacacaaaacttgctcgatgccgcccgccgtgcctgggtcacgggtaaggacgagtccggttatcccacttggcgcaaaggcgttcgttaccatcaagtgtctaccgacgaagtttacggctcacttggtgccgaaggctacttcacagagcaaaccccgctctgcccgcacagcccttacagcgccagcaagacgagtgccgatatggtagtgatggcctatcacgatacctataagatgcccgtcactatcacccgctgttccaacaactacggtccttatcacttccccgaaaagctgattccgcttatcatcaagaatattctcgaaggcaagaacctccccgtctatggcgacggcagtaacgtgcgtgactggctctacgtggaagaccactgcaaagctatcgacctggttgtccgcgagggtgtggaaggcgaagtctacaacgtaggcggtcacaacgaaaagaccaatcttgaaatcgtgaagctgactattgccaccgtccgccgcttgatggaggaagaaccccgttaccgtgcagtgctgaagaaacaagtaaaagccgccgacggcacgattgacatcagctggataaacgaagaccttatcaccttcgtcaaagaccgcctaggtcacgaccagcgttatgccatcgaccccacaaagattaccaatgccctgggctggtatccggagacgaagttcgaggtcggcatcgtcaagaccattgaatggtacctgaacaaccagccgtgggtggaagaagtgaccagcggtgattatcagaagtattacgaacagatgtatggaggtagaggttaaggtttagggattagggtctaaccgctaatccttaacctctaacctctcaattcagcgccaccgctaacagtaatcctaagaacagcatattgcgcgacgtctcgcccagtatgctgttcagctttttaccgctacctatctgtatcattttgcgccacgtcagtgcgtgcatatagagatagacgcagggagcccagataaattccagcggagtcagcttgcccgtgtagacaaaccagaagcagagcagcacggcggcgatgcccagtgccagatacatattctcaccgaacttcttgccgtagcgtaccaccagcgtacacttgccgctcacggcatcctgctcgcggtcgcgatagttgttcaccatcagcaaggtgtctatggcgaggccactgacgagcgacagcaccaccacatccatattcagcgtataggcctgcacgtagtaggtgccgcatacgggcacgaagccgaagaacaccagcaccagtacgtcgccccagccccgataggagagcagcgtggtatagaggaaagcaaacagtatgcacaccacgcccagcaccaccagttcccagcctccgtggggcagctgcccccagacggtgaacagcactgccagccctgccaggcacgacagtgtcagtgcgatgccgatgccggttttcatggctgccggcgtaatccaaccttcggcgcaggcgcgctgtggccccagccggtcttcccgacggtcggtccctttctggaagtcgaagaggtcgttgataaagttggcggcaatctgcatgccgcaggcaaagagggcgcacagcagggcgggtgcggtcttgaactgtccgtcgctgaaggtaagggcactgcccagcaataccgggatgatggctcccgtcaacgtcttggggcgggcggcgagaaaccatgcgtagggtgaattctgtttaatctcgttcatcgtagttccaatttagttcggcatctgccagcaaaaatactgaaaatccctatatttgtacccacttatgatgaagaagttagtctacatatccattctttctctgctgctcttgtcttcctgccgttccaagcggatgattaccgtgtcgttgccgcagccagtcatgcaggcagacagcacgcagcttggcgatactatcgggttgcctgcccgcctttcgccgatgttcacctttgaccagtctgatttgcgtaatgtccgccgccagccggcgaagggcgaggtaaagaaacagcagataaagaaaacggcaccggtacaaaaggtaattgtgcagcgaggtacaagaatcacatcgaaaaccacccacgtaggctcggcctataagggcgtcagccgcattaagacgtacgacttcacgcatcgcgacgtgcctgccgccttcgagggcttccgcatcgcctttgtctccgacctgcactacaaaagcctgctgaaggaggagggattgaaggacctggtccgcctgctcatagaccagaaggccgacgtgctgctgattggcggtgactttcacgaaggctgccagtacgtgccgcccgtcatggctgccctggcgcaagtgaagacgccgttgggcacctatgccgtgcttggcaacaatgactacgaggcttgctatgacgacatcgtgcgcgaaatgaggcattatggcatgcatctgctggagcataaggtggacaccctgcggcgtggcggtgagcggattcttgtggcgggcgtgcgcaatcctttcgacttgggcaagaacggcacatcgcccacactcggcctttcgcccgacgatttcgtaatcctgctgacgcatacgccagactatgccgaggacgtcccggtgacaaactccgatctcatcctggccggacacacgcatggcgggcaggtgacgctgttcgggctttatgcaccgatagtcccctcgcactacgggcagcggttcctctccgggctgaagtacaactcaaagaacatcccgatgattgtcaccaacggcatcggcacttcgcagaaagccatccgcatgtttgctcccgcagaggtggtgatgattgtgctgcaccggctgacggactgatttattcttcgggcatcagcaccactcccagtttcttcttgccatccatctttaccaccatcggctggtggaaatgtacatgccgcaggtacttcgtctcgtgtacggcaggctgtgcattcaggaattcctggttgtatacgccgtcattcataaaggcgttgatggtaaagtatcccactccaaaggaggtcaggttctggaagaagtgggttccctggctggggtctacccggtagttggtcagtccggcttccactatcacgcgggcagcgctgatgtgcggccacttcacggggatgccgagccaggtgtcactgctaccccagcgtccgggacctacaaggacatagttgcggccttcgtccaggaactgctggttcagcttctctatctcccaggcaatctcctggttgtgggaggcactatagtcgtctgtcttcacatagataatgtcatgtatctcgttcatgatgccatgtcccaatgagttgttggaacggagcagtacctggtcgtccggaatggcggtaaggtcttcatccagcatctccttggtgtcgactatcgggcggatttgcagcaggtagaaggtgccggttttgtccttctcgcggctcatggtggcggcaaactctatctctacgggacggcgcatctcctgctctccgtatttcaaagccagttgcaggatgcgtggcagggggaatacgtcgtgttgcaggatgttggcaaaggtgatgactttgcgtccgccgggataaagcccgtcgcggataatctggtcgtaagggtcgtaggtggaggctatgtagttcagtgctccgtccttttccgcttctttgacgtgcagtttcagcaggttgaagccgtcgtcgatggagaagtcgtgaccggcattgcgcaggtcgagggcatagaagcgggtctgagtctctttgagggcaatctccatttcgctggtttgcagcacctggttggggtgatagggcgagaagcggagcgtcatgccaccgtccacgatgtatttacctaaaccgagcgccagattgacgataccttcttctgccttctcgtcgccgatggggtagtagttgagcgaacgtgccacaccggacatgctggggtagtagcggtcaccatactggttgcccactacctcttgcaggatgacagccatcttttcctggtcgataacgttgctcgttgcctgcatgtatgccttcgagtcgcggaagtagaccgaagcatatactcccttgatggcatcgctcagcatgcgcagcatctcgtacttgtcgtccagatagggaatcatataggtgttgtagataccggcgaagggttggtagtgcgagtcttccaacaacgaggacgaacggatggcaaggggcgacttcaccacgtcgaagaaggtgaagaagtcctccaccaggcggtcgggcagctttgctttgaggaagtagcgcaggatgacgtcatcgtcggcatcggacaaggctatctgatacagattgttggtatccataaactcgtcgaacacatcggtacagagcacgatggtcttggggatggcgacacgggcattctcaaactcttcgaactcggggtgatgcttcaccaggttgtcgatgaaagccagtccgcgccccttgcctcccagcgaaccgtcgccaatacgggcaaagttggagtatcggtcaaagcggtcgcgcctgaagactgccactactccctggtttttcatcttgcggtatttcacgatagcctcgaagataattttacggtgggcatccacgtcttgcaagctattccaggtgatgggccgcaggaactctgccacgggaaacatggcacgtgagtagagccagcggctgacgtggttgcggctgatgtggtaaaggaatgattctgccggaacagcaaaaagaatgttctgcagctctttgagattctttacgcgggcaatctcttccagcgtgtccgggttgcggaagataaagtcgccgaagccgaaattgtctgatacaatacggcgcaggtccacatccatctttttggaattcttgtcgatgaaggcggcatcgtatttggctgcatacgctgcgttgtccgattcgctggactgtatgataaggggtacaaacgggtcttccttgcggatggcggcacagagcttgataccggccagtccgtccttctcgccccgttctacgcgggggaagcgtacgtcggtgatgacacctaatatattattcttatatttttggtagatgccaaaggcttcttcataggtacgtgccagtacaattttgggacgtcccctcatgcgcagtgtgcgctggtgggcattcagtgcttcagtagagaattcctggctctgcttcaatacgaatttatacagattgggcaggatggaggagtaaaagcggatgccgtcttccaccagcaggatgagctgcacacccacttcgttgacgtcgtgctccaggttcatcttgtcctctatcagcttgatgatggaaaccagcaagtcggtgtttcccagccagcagaacacatactcaaagggactgaggtcttcattggcaatacgcttggtgatgccgtggctgaaaggggtaagtatcaccatcggaatctgttcatacaggtttttgatgtatcgtgccacgtcgaagctgtcgttgtctcccgtgcccggcatgcagatgatgaggtcgaaagagatggaggacagctgtgtcagcgcctcctcgcaagtggaaacctgcgtgaaacggggagggtagcgcaaggagagcgaagtgtattcattgaatatcttttcgtcgatgcggccgtcatcttccagcatgaaagcatcgtaaggattggctatcagaaggacgttgaaaatgcgccgtgtcatgaggttggcaaactgtgtgtccttgaaatagagctggtttaatttgaacttactgagcatggcttctcatgatttgttggtttcggaaggcaaaagtaatagaaatcgaacctattcggatagtttttcgaccgttttttttatatttatgcgtaatattgcatccgaaaaacaatatatgacctatgtctgctccatatccgtttccatataaatccgttgcatgtacatttctgctgttatgggtgttcgtttttttgtccgctgacttgtttgctggttcattccgcaccttgggtatcaaggagggattgggcagtcggcaagtattccagataaacaaggattcggccggatttgtctgggtgtatactcatgtcgggatagatcgttatgacgggaatgaaatcaagcattacaagttggacggaatggttgattccagggacaatatccagtcttccactaccatgatgtgtgataaggagggtattgtctgggttgcattgaagaatggaaaaatctatgcatacaacaaactgacggactctttccaattgcgtgtggacttggccgattacctgccttctccggtattgtataatatgctgtttgatgacgaaaaccgtttgtggttgtgtatgtcgaaggggctttattcttgggaagaaagtgcaggactgtcttttgccggattgaaggggcaatctgtccgttgcatggtccaaatggaagatgaagtgttttttgcaggcaccgacaagggtgtcttccggctgacgaaggcaggagcggcaggttcttcgtcttttgagacgaggccggttgacctgcatacagagatgcatgtggaatcgctctatgtcttcggagcgaagctgttcatcggtaccttttcaaacggcgtatttgtgcttgacggtcccgaagggcaaatacattccttgaatgaccggattcctcatgtgcctatccgttcgtttgcaaggacaaaggataatttgctgctggtgggagccgacggtgcaggtgttttttgcatggatgtcgctaccggagaacttttgaaccattatatgaataacggggatgatgacaaaagcttgagtggtaatacggtatccgatatttgtgtggatgaatccggagttgtatggattggcacttctacgaatggcatcagctatctggatccggagatgccggatgtctatagaatcaggcacgaacgcaataatgataattccctgaagtcggaccatgtaaatgtgatgtttcaggactcggagggagattattggtatggtacaaacaacggcgtcagcctctatcaacctcggtcacgcaaatggacccactatctggacggtacggaatatagtggcaaagtggtattggcacttgccgaagactccgggggaaacatctgggtaggtggctatggtatcggtgtctattgtattcataaacagaccggacgggtacagaagaaagagaaaagaaatgcacatccggagaagggaatggccaccgactatgtttatgccatttatgcggaaggggattatgtctggttcggtggtattgaaggagagtttacccgttacgatatacggacggatacttatacatattacccgattgattgcataggtgacataaagccgggtaaggggggctcattactgattgccggttgcagcgggttggccgtctttgataagaagtcgggagacacgcagtggcatcagacgtttggagacatctctctgcattatcctgtccgttgcctgatgcagtcctcatccggtgatatttggctggcgacagacggggaaggccttatacgtgttggtccggatgggaaagaggcgcatgcatataccgtagatgacaatctggtttccaattccatcaacagcctgctggaggataacgaagggcgtatctggttcagtacggagaaggaattgtattgcttggactgctcccgggatattatcatcagtgccaatgattttttggatgtcagctggggatattacaacccgaatgctgcccttaagttgaagaatggatgtcttgctttcggcaccgcagaaggggttctttcctttctcccgtctttggacttggggactcatgcacccgttgagctgattctgacagactttaaactgctttatgaatcggtcaaagcgggaatgaaaggctctcttttgcaaacgaatatcaatgatacccggaaaatagatttgaagtataatcaaaactccttctctattttcttctctgccatcaactttgcagtcccgcatcgtatcaggtatgagtataggctcgaaaatcacaatgaggagtgggaacactccaattcagtgcggaacgtgagctatatgaatctctcgtccggtaagtatgtattccgcttgcgggcatttgataagtacaccgggcagcaggtgggagaaagaagtctggacattgtcattcataacccttactgggtttcgtggtgggcgctgctcctctatttcatcttgttgtttgtctttgtctgcatgtttgtgcagtataggaggcataaggtgaacgaggggcgtataagggacaagatacgttcctttatcagtatagcccatgatatccgtacaccggttactttaataaaggctccgctgagcgagctcgaagcgcaggagggacttccggagcagggtaagaaaaccgttgcggtggcaatgaagaatgtggaaaaactgatgggaatgattactcaactgcttgagttgcagaaaacggaactgcatgccgaggagtgtctgaaggtttctccatacgacattaaggcttatctggaggaaaagatggcggagtttcatttagccgccatgcagaagagcgtcgggatagagttggaggtggagccggatatgcccaaggtttggattgaccgggagaagatggatcatatcatagacaatctgctctccaatgccttgaagtatacagagaagggagtcattcacatactggtgaagactgcaagaaagaagtggactattgaagtgaaggatacgggtatcggcattccgaaagaggagcagggcaatatttttcacgaatattatagagcccagaatgccatgaactttgaggaaaccggttcgggtatcggtctgatgattacgcgccgcattgtgaaacagcatcacggcaccatctctttcagtagcgtggaagggcagggaactacgtttacggtaactttcccgcagaggataaaggcgagcgtggcggtggaagcgaaggctgacggccgggaagaagctcaggccgctaccggggctgtgcatgaagaaacggaacgtgccgggaagaatgtccttcttctggcggaggacgatgcggatatgagggagtatctggtggacagcttgtcttccgaatataaggtagttgccgtgcccgacggcggaaaggcattggagacggcaagggaaatcaatcctgatatcattatctcggacattgtgatgccggtactggaaggtgatgaattgtgccggattctgaagtcatcggtagatacaagccatatacctattatattactgaccgcactgagtgagagggaaaatatcatcttcggactggaggccggtgccaatgactacatcatcaagcctttcgacttgtctgtgctgaaagtgcgtatcaggaatattcttcagaataggcagcatttgcgcgaaaccgtgttggcgatggatgcgcagcccgaagagacagactataccagccagttggacaaggagttcctggacaaggttatgaaagtgattgaggaggagttgtccgattcggaattctccatcaatgacttctgccggatgctgggcatgagccgcacttctgtctacaataagataaagacgctgaccgggcagggaccgaatgacttcatccgcattgtccgtttgaacaaggcaaaagagctgctggtttcccggaaatattcgataggggaagtggcgaatatggtcggattttctgacccgaaatatttcagtacatgcttcaaaaagcagtttggtaccagtcccagcaaaatttagagccatgaagactgcttttgaaccaccgctgacaagtattaaaccttttttgtcagagaataaacccttgtctccctgatagtgcgtaatattgtggacagtaaacaatattaaaaaacgcatataaaaaatggaaacgtatttaggtcttgatttaggaggcacgaagttgctgattggcgaaatggatagccgtggcaacattttgaggtataagaaatatgactccggttactttaatcagcaggctgcgctggaaatcatcaagtcgtcgctcgatgattatatccgtaccgtgggctggtatgaccagaaaccggtagcgatgggtgttgggctgatagggcgtgtagatcccaacgaaggtgtctggctgcagattgacccgagcaggacacagcggattgagttggcaaaggaactgtcggatatatatggcatgccttgccatatagacaatgatgtgaagagcgctacaagagccgaacgcgtctggggattcggacaaatttccaaaaactttatatacgtaaatgtaggtacaggcattgccgtgggtacggtgataaatgggagacaaatccgtggcagtcatttcaatgccggcgaagtgggacacgtgcgtgtaggtgtgaacataggcattaaatgcggttgtggacggatggactgtgtggaggcgattgctgccggcataggttttgacaattgtgcccgtctgctccgcaaccagtatgagaccggcctgcatattccggctgaaaaaggggaacgggtgattgtgagtgaggtgtttgcacttagtcagaaaggtgaccctctctgtacggtgctggtggagaatgcagctgaggcgcttgccaatcttatcatgaatctggtacgtgtgattgacccggacacggtggtgttgggtggaggcattgtggccgacggatatatgcacgagaagattctggagaaacttcatcctacgaccatgcgttttgtcagcaacggggttgtcattacgaaactgaatcccggatttatcgggcttctgggggccggcgcggtggcgatgaatatgtgattaggaattaatgattaagaatatgaaaataacaataacaaagaatgaaaaggagtttgactgcacggctgcatggcgcatcatcgggcagatgttgaatgaaccggagagtgtgataggactttcgacgggacgtactaccggcaatcttcatcggttggtgggagaaatctatactaaatatccgtttaaggtggataccgttactttcttcggattggatgaggtaacgaatgtgccgcgcgaatatgccggagcatgctacacgatgctgaaaacggagttgatggatacattgggcatcaaggaagagaattttttgatgctgcctaccatttctggtgattttgaacagtcatgcagggatttccagcaggaaattgcgaaccgtggcggcattgatttgctgattttagggttgggtgagaacggacatctgggattcaaccagccggaatctccctttggcggtgaagcatgggtgacccggatgaatgtggaactggaagaacgcatccgtagagaaacgggtactcctcccgataaagagttgggaggggctactttgggaataaagaacattatgcaggcacgccggattgtactggttgccaaagggactaataaagcggatattgtcaagcggatgcttgaagggcctgtgacaacagatgttcctgcttccatccttcagcttcatcccaactgtgaatttctgctggatgaggcggcggcaagcatgcttaactgctaagtcgccttgcaggcggctgataactaattatttgaattaataatcaaaatactatgacacaacaagaaaaacaaataaactatatggggccattcatcacgatggtgttcttgttctttattgtaggtttccttacgactgccaatactcagtttcagggtcctctgaaagaaacttttctttcggaagtgggcgggttgaaaaatacttttgctactttgattactttctcctggttccttgcttatccggtttgtggaggggtaggctcgtcgtggattagtaaatacggatataaaggaacattgatgcgtggattgctggtgatgattgtggggcttggtttgttctttgcctcttcctatttcacagtacactttcctgaagcgaattggcatgcaggaaataatgttatccctggagggttcttgattttcttactgggttctttcgtggtaggggcttcggctaccattctgcaagtggttataaatccttatctgacggcttgccatgtcaagggtacccagtccattcagcgtttggctataggcggttctgccaattctgtgggaactacgcttgctccttatttcgtgactggtgtcgtgtttggcggtctgtctatggaggacattcagattgaccagctgatggttccgttcctggcattgatggctgttatttctttgattgtattgttgttgatgaaattgtctttgcccgatatccaaggaaccagggtagagaagggagaaaagctggaaaaaagtgtatggtccttccgtcatctgacattgggcgtggtggctatcttcttttatgtaggagtggaagtctgtatcggggccaatatcaatctgtacgccatcgagatggattatgcttctccggcactgatggctacgctctattggggtggtatgcttgtgggccgcctggtggggagcagcctgagcaggatttctccccgcgtgcagttgacggttactacggtatcggcaggattactcgccctactggccattcttctgaataatccgtggctgctcacggcagtaggtctgttccattccatcatgtggggagctatctttactttgtccgttgcccatttgggaaaatacacttcggtggcttcgggtgtgttcatgattggagtggtaggcggtgccatattgcccttgttgcaaggagtgcttgccgatgttcttggaggctggagatggtcatggttcatcgttctttttggagaaacgtttatgctgtattatgcattgataggttcacgggtccgtcagacctgcgataatttgtaattaaagatagtacttatgaaaaaaattaaaatgatgatggctgctgctttgggcgtattggtttcatgcggtagcgttaagtcgggagaagaggccattgcggcttcccgcgaatcaaaggttgtggttgcttatgtcacttcgtggagtgaggtgatgcccgacccgcagtacatgacgcatatcaactatgcgttcggtcatgtaaacgagagctttaacggtgtcaagattgataatgaggaacgtttgagacagattgttgatttgaggaaacagaagccggagctgaaagtgctgctttccatcggcggctggggaagcggacgtttcagtgagatggctgccaatgatgaatatcgccgtgcttttgccgcggactgtgaccgtgtggtgaaggagttcgctttggatggcattgacatcgattgggaatatcccaccagctctatggcaaatatatcctcgtcaccggacgatacggagaattttacacttctgatgcaggatatcagagctgccatcggcaatgaaaaggaactgacacttgccaccgtagcttctgcccgttacattgacttcaaggctatcttgccttccgtcgattttgtgaatatcatggcttatgacatggcttctgctcccaagcaccattcggcgctttatccgtcaggacatagcggtgacattacttcggacggtgccgttactgcacacttgaaagcgggcgtaccgccttccaagctggtgatgggtatgcccttctatggtcgtggaggtgacggttatcccagcttccaagactataataaggtagggaatacggatacccaatatactgaaaagtgggatgaggtggctcaagtgccttatctggccgataagaatgatacgttggtatttggttttgagaatccccgttcacttgccatcaagtgtcagtatattctggataaagatttgctgggaggcatgtattgggattatagcggagacaatgaacagggtgatttgcgccgtacggtagcagaaaacctattgggcaagccgcacaaggcgaaggtactggtgttgacggaacgtggcggacagcacggaggatttacggatgccggtttgaggtggttggcggccgaaggtgtaaaggggaatttcagtattaccgagataaacaatgccaggaacataacggaggcttacttgtcgcagttcagcctggttattcaattggatttcccgccttatacttggccgaaggaagcggaagatgcgttcgtcaagtatatagaagaaggccgtggcggctggataggtttccatcatgctactttgctgggcgagtttgacggttatcccatgtggcaatggttctctgatttcatgggtggtgtacgtttcaagaactacatagctccgctggccaacggtacgctgattgtggaagataaacagcatccggtaatgaaagatgttccggcctctttcgtggtgcccgatgacgagtggtatacttatgacaagagcccgcgccccaatgtacatgtactggccaatgtagacgaatcgagctacacgcctgcatcggacatcaagatgggcgatcatccggtggtttgggtcaatgaaagcaaaaaggcacgcaatgtttatttccagatagggcatagcagcaaattgtacgaaacggaagggtttacgaccatgttcagaaatgccattaactggactttagaaaggtaatactttttataatcaatggatttagaagaaaacgggtacgtacagaaacgtatccgtttttttatgggtttaaactttatcactttaagtttaaaataaaacgttttttatggatgtgttagtaaatgaactccttatgagaaatattcaacttccatttcttgtttagtacgtaatttcgcttatcgaagtattggaatttgtatcaatacaatatgaataacttcctattttataaactaatactattatcatgaaaagaaaaagagtccttttgctgctttgcattctcagttgcactttgcagctcttcgcacaacaaattaatgtgcagggtgtcgtttatgacccttccggagaaacggttccgggtgctaatgtcagtatgaaaagtaatccggctgtgggtactgtgacggacattgatgggaatttcagtctgaaagcttctgtgggtgatgtgttggtcttcacttttattggttatgagcctattgagtataaactgactgctgcagatacaaatctgaaagtccgttttactgattcttctgagttgctggacgaggtagttgtagtaggctatggtgtacaaaagaagagtgtactttcgtctgctgtgagccgtgttaccagtgaagagttggataaaggtaatcctacaaatattcagaatgccttgaaaggtaaagtttccggtgtacagattatctctaattcaggtcagcccggtgcggaatcaaagattcgtattcggggtactggtacggtcaacaactccgatccgctttatatagtagacggcatgccgtctgaaagtggtatcagtcatttgaatccttctgatattgagtctattgaagtgttgaaagacgcagcttccgccgctatttacggagcccgtggtgctaatggtgttgtactgattactacgaagaagggtactaaaggaaaggctactttgaactatgaatttacgtatggtattcagaatccttccaagaaggtggatttgctgggtagtgcggattatcagatgttgatgaatgaaatggctgccaatgcaggtaaggacccttatttcccgactgtttccagcgtcaataccgactggcaaaaggaactgcagaacaagaatgctcctattatgaaccacaaggtttcgttgagtggcggtacggacaactctacctattatgcttctttcggttatgtaaagcaagaaggtatttatgctaaaggacatgctgattatgaacgctacaatgtacgcttgaattacaataatgtattactggacacgaaatcacgaaattggttgaataagattagttttggtgcaattgcaagctattccaagtcaatccagactggtaatactattggcaatagtgaagcagcaggcttgattacttccatgaatatgttgcctcctaccgagccggtttatcagaccgaccctgctatactggagcaatatgccgtaacttatccaaatcatgtcattgctcccaacggcctggcatacaatatcatcgagatgcgtgaaataaccaatccgctggcagccatgcaggtcagtcataaccagaggactatgcctcagaatttcggtgcgaactttaaccttgatgtcgacttgttgccaggcttgaagttcaagactacctatggtgcggaatgggtgttcaattccattaagaatgtaactccagtctacgagctgaatgctaccagtaagaatgccacttccaaggtagaggataagaaaagggagtcttcctattggcagtgggaaaatgtactgtcgtatacaaagtctttcggccgtcataatataggtgcactgttcggtacaagtatgtcttcctaccattactccaatttggaagcggaagattataatctgctggtggtggatatagacaagggatatatagacacggccacagcgcccgaagagcagtccaaagtatggggtggggcagaagaccaccgcattgcatccgtattcggacgtatcaattataattatgatgaaaagtatttgttcgaagcggtagtgagacgggacggttcgtcaaacttcagtcgcgagcaccaatatgctacattcccttcggtttctttgggttgggtgttgactcgtgagaagttcatggagaacagaccttcctggttggattttgccaagatacgtctaagctggggacagaatggtaacgaacgtattggctcctttgcctatacaagtatgatgagtcagggtaagaatgcagtcataaatggaaaggtatatacgggcatgctgccccgtggctatgccaatgctgatttgaaatgggagacctccgaacagaccgacttgggtattgacttgcgtttcttcaacagtgcattgacattctctgccgactatttcgtgaagaagacgaaggacatgctgctttccatgccgattcctctttataccagttatggcagtatgacggtcaattcgggtacagtgaagaacgaaggtatcgagttcgaagcgtcctatcgctttaaggtgggtgaagtgaatctgggtatcaatggaaatgcttcttatgtgaagaataccgtaacagaccagggccccgaccgtgtcggtctcaataatatcggcggtggtatgggcggccaggtcagttggagagagaacgggcgtccgtacggcttcttctacggttacttgcatgatggcattttccagaatcagcaggagatagacaactatacctacgtagattctaacggaaagactcatttgatacaaccgaatgccaagcccggagatatccgttttaaagatttggatggtaaaaatggtcttaatggcgatgaccgtactatgataggtaagccgaatcccgactggacgtatggatttacgctctctgccgattggaaggggctggatttcagtgcattctttcaaggaagtatcggaaacgacatttataaactgtacagacgttccaatgtgacttttggtaactacgacaaatcttggctgaaccgttggcatggtgaaggcacttccaattgggtgccacgtgtgatagatggtgacaacaataactatcaggtttcaaacttttttgtggaagatggttcgtatatgcgtttgaaagtgttgcagattggctatagtctgcctggacagatgttgcagcgtgtcggcgtcaaggggctgcgtttctttgtgcagggcgaaaatctgtttacaattaccaactacagcggttatgatcctgaagtgggaacacgtgatggatttgacgggggaacatatccgcaagcacgtacttatactatcggtgcgaatattacattttgattaacctaaaaattagatacaatgaataagatattaaaggtattggctttgggtgcgatggctttgtcgaccacagcttgttcagattttctggaagtgaatccgagaactcaggtgtcggaaaccgaattctataagacggaagacgatatgatgaagggcttgtatgccgtgatgaatgaaatgcagacccgtatgccggaggtttggtcttactcttctttgctgggtgatgagtccgaaaccggcggtggtatcggtgaggggtcttacaagacgaaatgggatacttttacctatgacgcgacttcttgtttcggtgcatggggatatggttcttggtggaatgagtgggattttggcttgttcaatggagtcattgctgccaatctgttgattgacaaattggccggatgcaacctcagtgcagactttgtcaattccatttctgccgaagcgcgcttttaccgtgccattttctattaccatctgtttatggggtatgagcaattcccgcttatcaaacattatctggcagccagtgaaatgtatagcgttgccaaaggaacccgtgaagaaatttatgagtttatgatgggtgacttggatgacgaagtgactaagtatctgccccagcgcagtgctacacagcagggacgcgtttgccgggatgctgccaagctgcttcgtgctaaaattattttgttccatcgtgatgagactaaatatcaggtggcattgaatgacatgaaagaaataatcaccagtggaagataccagttgaaccctgattatcagaacttatgggtgaaagacggagaatggtgtgcggaatctatctttgaggtatgttatgccggcaataactccggcgaagggtttgggcttgcacgttctttgggtggtcgtaacattgttgacccgagaagtgccgagcagggtggattaggcgaaggttatgggcagaacaccatgccgagtactgtttacaacatgtttaaggaaggtgatacgcgccgtgagggaacagtcattgtctatgcggacgaggctaaaaaagtggcagaaatggtggccaaaggtgaactaccggcaggaagtgctttccaagtcagtgaccagcaggaaaattacgagggtctggggcactataagattcatccgagaaaggagacgacgtctacggtgaatcctacggataactattataactcttggcgtatttaccgttatgccgatgttttgctgctggctgtggagcttgatgtacgtatcaacggaactgccagtgctgatgcgcaaggttggttcgaccaggtcagagaccgcgctttcaaagacaaagagcatcgtatcaacttggcgggaaagagcaagcaggagttgttggatattctttttgaagagcgtgggtatgagtttatggatgaaatgcagcgttggtttgacattctgcgtttcgataaaggaacagagattttaggtaataaaggttggacggagaagttcaggtacttcccgattgaccagtcggaaatggatagagctaaaggtggcttgacacagaaccctggctggttataagttttgattgtttttttctgaagagtccccggtatttccttgtgaataataccggggattttttgttccttcacaaagtttgttttggcaaaacatctgtcatgctatcacgcaaatgggtgtattgttttgattataaatcaattaaagcgtgatagatacccgtgacagataaaaaacgttacaaccatctatcacgctttccaatctttctaaaagatgatgcctcctatttattgggtgaatcgtaaaagtggctattgtcttagttctcaacatgaaacttttagttttgagactaaatacgagaagttttgattgggaaaataattggtttcattaagggaaacctttagtttcctttcgtaaaactaaaagtttcagcaagtgaaacttttggtttcaacgatatgaaactgtcattccggcccgttgggaaccggcaagggtatctatataaaacgaccgaaacagatacttttcgaaggaaaagtatctgtttcggcataaaaacgtagtgttaacataggaaataggggaattatcccctatttattctcttgattgctgttatggaaaccgttttatttgaggaacgggttgccgcttttgtctttgctcactacccagcggaaagcattaaccaatagcaggttctgtgtaccgtcgataaactcttcgtcaccatgccccatattcaggtaaatcattctgtaattcttgttggaccatacgatggggaagtcgccaaaattcactacatccttgatacccagtggatagttcttgggagatagggacaagagtacctctacgtccttgttctggcgggggctgggagtccattggtaccattcgctggcgggagccacgaatgatgcaggcagattctaggtaacgggatgttcttcgttgtcgacttcgaccaataccggctggggaggccagttgttgcaatagaacaccccaccaccaagaaacttaacgaaccagggccaatgcgtgtttttgtcgttgtaggctgctgcgtggaaacctacccaaccgcctccgttttccatgtattgctcaaaagcatcgcgttcggccttggtgttgggggatgtgttaagcatgataatgacattgtattctttcagtttctcgtatgggtattttgaaaaatcggtagtaatatccagaacaaagccgtcaccgtaattgagcttcttgaagaaagtggttgcttgttctgcaaattgtacgtgtgcttcttccgcatgttgcgtgtaataaatcaaggccttgaagcgaggagctttggcatagtttgccggataaccttcggggacttgtgcgtacgtcagcaaggtgcaagccgtaaacaataaaataagcagatgtttcataatttgtaatttataagttattaattctccattatctaatattccgcagtcagagacagccatttgcctgccgaggtaacccatacctctttataacaggcattgttggtttgcggccaataggggacatcgtcgttacccagggtacggataccaacgggcatctctcctgtcatttctcccgaagagaaggtattcagttgcggatagttgtgtccttctccataaatcaaggattgtccgaaaggattcttgcctacggtccagtacaactgttccagaccgatgtcgagcagttccttgtccttcaggaagtttccgcagatggcggcggactttccgttggaaagatggatggcggtattgccgttgaagatattgaaccacacggggaagcgtttcatgtagtgctctttgtccagttgtactcctcgtttaatctgttccgtgtacagttccttggcattggcaggtggaaacagatggagggcgtagaagttggtggtatccttatattcctctgcatggtaaacaccgcttggaatcatgccgtagggatgggtatacttcatcattcctttcagatactctccatatagttgtatggaattcacccatttaggataatcggggtgctctttctgggtttcgcaaagcatcaccatggcctgcatatagacctgctcgcgcgactggtgtatgtaatgtacgatggatttgcgggatttgtcccggtagaagaatccgcgtgtcccgtcttggtctttcagcggttccgtacgttggcagtcgagggtatagcggatgtattcggcggcgatgtccgcataagaaggctttccggtcagcttgtataattggcttgccgaccaggagatggtagccatgtactggcttttcgaagtattgtagctgtgttcgtaaggctggacgaactggtcgaaaccgtctttcttgaatttctccatggcgaaagcgaaatcttcttcggccacgcgcagaagatattcctgctgcatcgggtcgttgtccagcgtcatggaggcatacgcctcatatccggcatagaggaaattgtcgaatgccatgttctgcacgcgtacagaagatatgtcgtccagtgtgttgaatacaccatcctgccagattagcaatcccatgctgctggcgcggtagccgtctccatagcggttctttagcataaactccactccccattccgcttcttcgcgcaggcgggcggcgagggtggggttggtgtttctttgtttattataggcttcgagcagggcgaaagccacatctcccgtctgcagggtctgctgggacaagtcgcccgcatcgtgccatccaccggagtaggagatactgcgtccgtcatgccgggacatcaggtctgcatggcaggaggcatgcttgccgggaactggatgcccgcagcgttggcaaaagatgaaattcagcactttccattgtgaatcttcccaaagccgttctccaatccgaaaggtgggagttagcgatgttccgaccttcagctgatactctccgggattattgaaggaggtgaaatcaataaggccaaattctccgagagtggttttctcttttcggatgtctccttcgtaagctatttctccggttggggtaagcagttggaagcgctttccggcgtctatggtgaggtttgtgttgatgagggcggttttggggtggttgacggcatagccggttgtcgagtaggagatttttccatcggcaggtatccatccgctgactttctcaggggctttcaccgtttgcagttgtagattgtctaggtagtagatagctgaatctcctgttgtccggtctttgcctttgagggctgtgctgaaggtgatggacatcaccttgtcgcgctgatactcgtctatttcgaggaagcattggttccactccttattaataaggttaatgaggtgtgaacccgaaggctgattatatcctttcttggcaggagtatctgcattgcgaaacgtgaggttcatgttgacaatacgcgccccgtcgcaatcggggtagatggagaatacaatacggttgtacttctccagattggcgccgtccagatgataggtaacactgctgtttccgtaggtggcatagtctgggtcggaaggagagccggtcgcccttttcccggtgaatgtggggaattgcagtttgatgctgcctttgccggaaacggtcttttccgtactgaaggacatgcttcctgcaccggaatgactccatccctctgttcctgccgagcgggtgaagggagtgctttgcaggacctcctttttccagccgttggcttcggaagagttttcaatatccaggggtaggggttgatgtatcagtccgctttcgtggagctgccgttccagttcggggtcttgggtcaggcaggtttgcccgtatgcggcaatactgccgagagataaaaggtataaaaataataatgtctttctcatgttgatgtcaacctttggtttcggttgcaatgttagccattattaggcagaaggaggtttgaaaactgccataaaagctttaaaagctatccgaagtagaggaaatatgaatttcggtagatgtataatccctatgatgtacgacttataatgccaaagaaaatactaaaatcgtattttcataacagaagaaaattgtaactttgcgaagttatgtcacaatgttaacctatgatgcgtatcttgattttaataataatgctgttgccatgttcgcttggtatgtatgcatctgcaatagatagccttttgtctgttctggataagactatcgtgatgcgtagacaatacgaggaagaaaaagaacggtatatctctttgataaaggatgagttgaatcaagggaagcttactgacatggaacgttatctgatacaaaatcgtctttttgccgaatataattcttatatcagtgattctgcgttgcattatataaatgaaaatattcttattgccacacgactaaataataggcaatggataaatagttctatattaaataaagtacatattctaaatacttcgggcctttttgttgaagcaatggaattactgaaatcgcttcctcgtaacacgttggagggtgaaaatatagtggactattatgtctgttttgaaaacctatatctctatcaggcagagtatgccactgatcggaactacgtgaacaattatcttcggatagcaaatttgtatagggattctataatcagcctagtaccggaagatacttatagatatgtagtcgtgcatgcaccccagctcattgaccagggaaaaagtcaggaggctatatgtttattgaagaattttttacctcggttgaaatccaatacgcgtgagtatgcagtagctacttcaattctggcttttgcttatcatgtcgtagggaacaagcaaaaagaaatggaagcacgtattagcagtgccattgctgacattagggcagtggtgaaagaaaattattctttgtgcgcattagcggaattactttatggaatgggcgatttggaacgtgctaatcactatatcaagattagtatggaagatgctaattattatactactcggttgcgtagttcgcagaattccaagatgcttccgctcatagatcgtgcttatcagcaagaaaaggaaatacagcaacagcggcagagaatgtttattacaggcatatgtatcctttctgttttccttctattgacagtactgtgtgtgctatggcaaatgaaaaaattgtcttatgcccgtaaaaaagttgttgctgccaattcccaattgagtatattgaatagtgaattgaagaagctgaacaagtctcaacatgaggctaatgaacgattattgcatactaatcagactcttacggaagccaatcatattaaggaagagtatttgggacgtttcctcagtttaagttcctcttatataagtaagatggaagaatatcgccgcatattgaacaagcaggctgctgccggtaaacttgaggagttatatcgtacattgaagtccgaccgtttcataaatcaagagttgaaagagttctatcacaatttcgatgtatcttttcttaagatattccctaactttgtagaagaatttaatcgtttgttgccagttgaagaacaattgcatcctaaaaatgaagaattgcttgttaccgaactgcgcatatttgcactgattcgtttaggtattacagacagtgcgcgtattgcagaatttttgcgttattccataactaccatctatacttatcgttccaagctaaaaaacaagtctctttgtaaagaggactttgaagaacgagtgatgaaaataacttctttttgattttatcctccttttgaggctttcttctgccttaaaaagtctagaaatgatttagaaattagtagcaatagcattttcgtaatgcgttgtattatagttgattgcctgttgtaggactttagatttttatctcagcccaaatcgtgcgtttgttttgataatacatttgcatcaatctatttattgtttaactaatttctaataagatgaaaaagaaaagtctaaagagatgccttaaaaagcgcatgatccttttactgggttttcttatgatgactggtgttgctgttgcacaacaacttcaggtacaaggaaaggtgaccgatgctacgggtgaaggtcttatcggtgcaagtgtattggtaaagggtacaacttcgggggtgataactgacattgacggtaactatgtgttattgaatgtcaatcctgatgcaatacttattttttcttatgtaggttaccaaacgcaggaactgaacgtatccggtagaaacaagattgatgttgtcttgcatgatgaccagcaggtgttggaagaagttgtagtagtgggttacggttcattgagtaaaaaagaagtttccagttccattgtacaagtggataagaaaaattttaatttgggggctatgaataacccgatggaaatggtatcgggaaaagtcgcgggcttgaatgtcaatacgcaggcagctgccaatcctaactccagttcttcattacaagtacgtggtgcaacatctgtttctgcaagtaatagtcctttgattgtcatagatggtgtggcaggtggcgatatccgtaacatcgctgcacaggatattgaatctattacggtattgaaagatgcgggttcagctgctatttacggaacgcgaggtgctaatggtgtgattttagttacaacgaaacgtggctcgggtgaagctggaaaaacggtagtcacatatgacagttacatcgcttttaatgtagccaagccctctccggatattctgtcggctgatgaattccgtcgttcgagacgaggtacagactatggagccgacactgactggtatggactgattactcgtgatgtagcatacgacacaaaccaatatatatctattgatggtagcacaaagaatggtttctatggtgcttccttcaattacaaaagtgccaatggacttgacatcgtgagtggtcgtgaagaatttggaggtcgtttttctatggaacagcgtgtactggagaatcgcttacaattcaacggttcgttgagtgcacgtcgtgtaaatgaaacctggggaaatgatggtttcttcgatagggcactcacaatgaatcctacaatgccggtatataatgcagacggttcgtattatcagcctacttctcctacgggtgcaaccaatccggttgcggagcttgctttgagagataacaacggccagcgtatgtatttgttgggtacggctgaggctaaactgaatattttgcagacagaaaagcatttgttgaatacaacattaagttactcattgcattacaatgacatgaagcaacaatattatgcttcgtctgccggttcggagtcctattggaatggttataaaggacgtgcggaaatgaagtatcagaaatggtacaccaatcgattggagtggttgggaaattatgcactgaacttgggcgaccacaatattaaggctgtagtgggctatacttatgagaagtctatctgggaacagattggtggtagtaacaacgacttctcttttgataatacgaaatattgggatttgggcagtggctcttatctgaaggatggtttggcaagtttatatagcggtcgctctgaatcgacacttattggcttctttggtcggttgaactataattggaaggatatgctttttgcatcggcttcgttgcgctatgaaggctcttccaaatttggtgctaaccaaaagtgggggtacttcccagcagcttctttggcttgggaaatgatggagatgggctttatgaagaatacccggaaagtgttgaccagtttgaaaccacgtgtttctttcggtattaccggtcgttcggattttgatgcttataaatcactttctacttataataccaatggtagttatctctttgacgggcgttgggtaacgggttatgctccctctagtaatgctaatccggatttggcttgggaaaagagcgttgcgattaatctgggtgttgactttgttctatggaatcgtttacgtggttcagtggagtattttgaccgtagttctaaagacttgctttatacgtacacggcacctcaaccgccttttgtctattccactattttggttaacgttggaacaacgaaaaataccggtatagaagtatctttggatggtgatatccttactaaaacagcagtgaagtggacgagcggaatcaattattcttatggaaagactaagttgaccaaactttctaacgatatttacaaggcatcttatctcgacctttacttaaaaccgggaactggttccagcgaatatttcttccgtgtgcaggaagggggagagatagggcagttctacggttatgaatatgcaggtgttgacgaaaatggcaatatgcttattttgaatgataaagatgagcaaatacctatttctcaggctgatgccaagtataaacgttatattggcaatggtgctcccaagcacttcttgtcttggagtaacaacctgacttggaaaaactttgatttgagtgtattcttccgcggtacattcggttttgatgtattcaacatgcgtaaatatggtatggggcttcagggatgtggtacagataatgttcttcgctctgcgtatctggaagataagaatatccgtaccggtggtggagtaatatcttcctatttcctggaggatggtagcttcataaaactggaaaatgtaaccttgggatataattttactcctaagaaccgtaagttactggataatatgcgcatatatctgtctgccaagaatctgtttaccttgaccggatactcaggtaatgacccttcaattatagacgtgaatggtatccagccgggagtagatagtaatagtgcttatcctacagcaactcaattgagtttaggtgtgactcttcgctttaaataaatgagaaacaaattattaaaaatatgaaagatatgaaatatataaaatgtcgttggttattggcgatgattatgtcatgttcacttttctcttgtactaatttggacgaggaagtgttcgatcgtgtggatgccggaatttattatcaagatgagacgagtgttcagggggcagtggcagccatctattcgaaagctgcatatagttatttggaatacttctggtatttgcaggagttttctgccgaccaggtggcatggcgcagttggaacggtggactttggggatgggatgaggcattgaagtttgctttgtcttcacatacctggacgtcagaatcaaccattattcgccaaacttgggagaatgcgtggaccactattgggctttgcaatacgcttattacagatttgcaggcaatcagccccgcatctatacgcatgactgaggatgctttgaatagttatattgccgaagtacgtaccctgcgtgcttgggcatactacaatatctttgagatttggggtggagcacttcccttgaacatttcttcgggtgcggaaatccctggttctgcagatactgattttgataaggggtgcaagattatctacgattttatcagtcaggaattagatgagtcagttacagatcttatgaaagaagatggttctggaaagactcgcaaccgcatgaaccaagctgccaatcgtatgattaagatgcgcttgttgctgaattctgaggtgtttatcaaacaaaacagttataatgagtgtgccactctttgccaaaaaattctgaatggcgattatggtacttacagcattaccgatgactatcgcgatatttattcgataaacaatgtagaatgtccggaagttgtaatggcattggcgatggaagtcggtcaggtcaataccggttggatgcgtaacatgcctttcatgccttacaattgttgggattattttggaggtacatacagccagagcggatggaattgtgtatgcttggcaccttcatgggataattctggaaatgtacagccgtatggtggtactgacaatcctaagagcttccttactgactacggtgataagttaggagcagtttatgaacgtttccacgataaagatatccgtaagcagaactatgtgtataatgaaacaacaggaaactatcaaggcatttttttgaaaggggctattaaagccaactatggtaagggtgcggctttgaaagcagatgccgaccgtgacggtcaggatttggtttatgtggatcaggtgggtacattccttaatttaggacgtaatctggagactgtcatgtcacctcgctggggtgaaacgaattcaggtgtccgtttggtaagatatccggtttatccggagagtgcaggcattgatttccaaaacatcgatgaggtggaattccgtttgagtgaagtggtctatactcttgctgaatgtaaaatgcgtgcaggtgatacggaaggtgctaaagaactggtatatagagttaaaacacgctattttacagataaatcggctctcgaacagcccggtcctggttttacatcctttgatatggattggatgttgagtgaatggggacttgaattcttgggagaggggcgtcgtcgtcgtacagacttgcgtcgtttcgataagtttacgcaagggcaatggtggttctttggccgtgccacggacgacggtttaagctatccggctaaacgtgaccgcaaatacgagtggtatcccttgccccagtctgcccttatggtaaatccgggactggtacagaatcctaattattaatcatcctataataatagtaacaatgaaaaaatatatatgtaatccgctatggcttttgttgctttttgtagctttcatcagtagttgtgacaaggaggaaattgtgtttgaccatgagttgccgcaatttgaacttcgtagcgatgctatcttgctggaggtgattatgccccaaggaactggtgccgatgaaataatttatattgcaggcgatttcaatggaggtcaggatgctgcttccggagaccttaagtggcagatggagaaagctgcaaacaatgatgttaaatggggcatatacctctatccggaagattttgttaatggaaagacacttgccgatggcttttatttcgtttctaagacacaaggtatagagcgtactttgcagaatggggatgctttacatcaaatttcggctaaggtaggtactcgcactgatataacggtaacccgctggaatgcttattttgaggagccggaagacccaagtgaagtgacccacgacggttatgctgtgttcgtgatggacaatacaggttgggatgcactgacactttatgcgtggggaaatgatttgccggaactttttggaggttggcccggtatttcacctactggtagcgttgagataaaaggaattacctataaatactttgatacaggtgaagcaaataagggattggtttacaatttgatatttaacgataatggagtaggttcacaatttgatggaccacagaactttactcttgaccgtgacatatatttggaaatcacagaaagcggttggacggaaatagatccggatgcagtggtcatccatgatggttataccatttttattgaagaccagtccggatgggcagaaacaaccatatacgcgtggggaaatgatataccggaactctttggcagttggccaggaatattaccaaccggtagtgttgagataaaaggtgtcacgtataattattacgatacaggtgaagcaaataagggattgacttacaatctgataatgaataataacaatggaggctcacaatttgacctcgcagcagtgacgcttgatcgagattattatttccgtattacggacatagctggtgaggagattgaccctaacaatccggacggagactctgaaccggaatctgaagcggcttttgtttctaatcagaataatttcttgaaatgagttttgtatagtaatgaagatgttaaatgacctattggtggaatgagattggggataggatatctcttttcaatcttgcggatatatgtcccaaggcttggtttttctatcccaagtcttgggatagaaaaaccaagccttgggaagaagttatctcttagctcttttgttttttagtattggcttccgggatttttagtattaaggcttagtatcttttctgccaatgcccattactggagagtttggatgctccttttgcagatatcagttccgccaatgagtataagtatagataaaaagtagaaatatgaaaaaagtaataattgcgacactgctctttacgatgctacattcttgtatggggtgtagtgatagtcagagtgacatggaaccgattcccgtcccacaggaagaatacatggcttcggatatggtgatttatgaggcaaatccccgcatttttgccgaagaaaatgcgttctctgccatcaaagcagagcttgaccgtattcaaagcctggggactaccgtgctttggctgatgcctgtaaatgagccgggagtactgaaaagtgtgaattcaccttattgtataaaggattataaaaagctgaatacacgttacggaacaaaaaaagacttgaaagaactggtagatgctgcccatgccaaaggaatgaaagtgattcttgactgggttgccaaccatacttcgtgggacaatgcttgggtgactgagcatccggattggtatacacaggatgcaaatggcaatgtggtacaacctcaagaacagccttgggcggatgttgctgacttgaattttgacaacgaaaccatgcagcaagccatgattgatgccatgaagtattgggtaacagaaattggtattgatggataccgttgtgattatgccgagggggtaccagatgctttctggaagaaagcaatcgccgagctccgtacacttgacaataatttgctgatgcttgccgaaggcggaaaaacgtctttaatgaacaatggtttcaatctgctctacggctggaacttccatagtaaactgaaagactattatgccggtaaatgctcacttactgacctttatgctatgaatacttccgaattggagggaatgccgaagggtacgttacggttacgctattctactaatcatgaccaggcaagtgaggcttcaccgatagaatgttatggcggtgagcgtggtgccatgtctgcttttgtattgacgactatgctcgaggggatacctcttatttatagttcgcaggaagtagcctatccgcggtcacttaactttttcaattacggagttatagacttgaagtccaatgaagtctttgcgcaagagatggcagaaatcatcagagcttataaagctacgagcagtgtacgtggtggtgaactggaagtttatactaccggagatgtcgcttcattttatcgggcagcaggcagtcatggcatgttggtcatggtgaataccgccaatgagtctgtacaagtgaaagtacctatggagcatgctggcaagaccatgaccgatgtgattgccggtgtggatgtgaagttgcctacagtaatgacgatggaaccttatcaatattttatatatcaacaataacggatgtatatgaaacatgtattattaacagttgtatttctgggaattgcttgtgtggcgatggcacacgaattgttatctcccaatgggaatctgaaactcaatgttgtgcttgattccgagggggggccggtctatagcttatattacaaaggagagccggttgtagaaccttctgccttgggaatacttatggaagaagcggatttgtcaaatggcttccggattcttgatgcaacaaattctacttttgatgaaacctggatgcctgtatggggagagtatgaaaaagtccgtaaccattacaatgaacttactgtcactctctcacaaccggcaaagtacgaccgtacgatgattgtacgttttcgattgtttgacgatggactcggattccgttatgagttgccggagcaaaaaaacatgaattatctgacggtaaaagacgaactgacggaattcaatctgaccggtaatcatacactctattgcattcccggtgattatgatacgaatgagtttgcctatactactgcggccatttccgaagtgcgcgaagctatggaacgtaatctacgtaaaaaaggatatgaagctaaagcgacttcattcacagtacaaacaccccttatgataaagactaccgaaggactttatatcaatattcatgaagctgccttggtagattattctgccatgttgctgaatgtggatgataaagagtttaacttttctgctcatcttactcccgataaattaggaaagaaaggatatctgcaattaccgttgcataccccgtggcgtacaattatggttagtgacgatgcacgtagcatccttgcttctcagttgattcttaatctgaatgaaccttgtaagctggaagatacttcttggattaagccacagaaatttatcggtgtctggtgggagatgtttactggtggaggaggtacatgggcatatagcgactattataaggctaaacccggcataaccgactattcaaagttaactcctaatggacatcatccggccaatactgaacatgtgaaagagtacatagactttgcggcggagaatggtattgatgcggtattggttgagggttggaatgaaggttgggaagattgggtatcctatcgtaaggatcgtcagttcctttttgacaaaccttatccggactttgatgttgcggtactacatgcctatgccaaatcaaagggggtaaagattatcatgcatcatgagacggctgctaatgctgccgattatgagcggcagctggatgtagcctttcaatttatggtagataatggctataattctgtaaagaccggatatgtgggttcaatcattccccgtagtgaatatcattcctcacaatggatgaacaatcattatatacatgtggtgaagcgtgctgctgattataagattatggtagatagtcacgaggctgttcgtcccaccggcttgtgtcggacctggcccaactgggtagcgcaagaatctgcccgtggtggtgagtttgaatctatggggggcaatgatccggatcatacttgtatcttgccgtttactcggttgaagggtggtccgatggattacactcctggtattttccagacaaaactttcgtattataatagttcgaaacctaaaggtcaggcgggtactacattggtaaaacaattggctctatatgtaacgatgccctctccgttacagatggcagcagacctgccggataattatcgccgttttcccgatgcgtttcaatttattaaggatgtagcggtggattggagcaattcttggtatctggaagccgaaccgggtgattatatcacagtggctcgtcaagccaaaggaaaacaagagtggtatgtaggtgctattaccgacgaacatcctcgtacggcaactattcctttctctttcttacccgaaggaaggaaatatattgttaccgtttatgcagatggtcgggatgcagactggaaagataatccgcagagctatgacatccgtcgtggcatagtaacgtcaaagagtgtgctgcgtcaacctctggcaagtagtggaggggtggctatcagtgttcgagaagcaacaaaagaagaggtaaaaggattgaagaaattatgaagcttgtccgtacatagtaattattatgttgcggatttaatacaagcatttaagaattaaagttagcaattggaaaggcatagtccgtgaggattgtgtcttttttcgtaaattattcgtcatttcttatttgctttattataatttttctatatttatgccgttatggcgaattgttgacagaataggaaaagaatagaccatttaggtatgaatagagaatgctggggatttgacattttatcattctttaatcaaaatataaccgtaaaatttagctgttttgaaaagttttcttatatttgcggtgttattcgttgacattttgtttgaatagcgtaaagtcaacaaggtaataacctttaaaacgtaatattatgaatatcgaacgtatcatgacctctttagaggcaaagcaccccggcgagtctgagtatcttcaagccgtaaaggaagttcttctttccatcgaagatatctataaccaacatcccgagttcgagaaagcgaaaattatagaacgtctggttgaacctgaccgtatctttactttccgcgtaacgtgggtggatgataaaggtgaagttcagacgaacctcggttatcgtgtgcagttcaacaatgccattggcccgtacaaaggcggtattcgtttccatgcttccgtaaatctttctatcctcaaattcctgggatttgagcagactttcaagaatgccttgactacattgcctatgggtggcggtaagggtggttccgacttctctccgcgcggaaagagcgatgctgaaatcatgcgtttctgtcaggccttcatgctggagttgtggcgtcacctcggtccggatatggatgttcctgccggtgatatcggtgtaggcggtcgcgaagtgggctatatgttcggtatgtataagaagttgactcgcgaatttacgggcacatttaccggtaaaggcttggaatttggcggttcgctgattcgtcctgaagcaacaggattcggcggcttgtacttcgtgaaccagatgttagaaactaaaggtattgatatcaagggcaagaccgttgccatctccggtttcggaaatgtggcttggggtgctgctaccaaggctaccgaattgggtgccaaggttgttaccatctccggtccagacggttacatctacgatccgaatggtatcagtggcgaaaagatagattatatgctggaacttcggtcgtcgggcaacgatatcgtggcaccgtatgccgacgaattccccggctctactttcgtggcaggcaaacgcccgtgggaagtgaaagtggacatcgctctgccttgcgctactcagaacgagctgaacggcgaagatgcacaacatctcattgacaacaaggtgacatgtgtaggcgaaatctccaatatgggatgtacgcccgaagctatcgaccttttcattgaaaataagattatgtatgcaccgggcaaggctgtcaatgcaggtggtgtggctaccagcggactggaaatgtcgcagaacgccatgcacctcagctggagtgcagccgaagtggatgaaaaactccacgccatcatgcacggaattcatgctcaatgcgtaaaatatgggacagaacccgatggctacatcaactacgtgaagggagcgaatatcgccggtttcatgaaggtggctcatgccatgatgggtcagggaattatctaagagagaaactttgtttagttgtatttgtatttgtggtttgtgctgccctacgcctgtgaaggtatcgggcagtactttttttattctcaattaaaaaagttgtatctttgtatccgagaaaccataaatgacaaagagatgttactacctgaattgaaactgagacgtgataaaatacgctctctcatggctcaacaagagattgatgccgctcttatcgcttgcaatgtaaacttaatctatacgtacggacgtgtcgtcagcggttacttgtatctgccgttgaatgctcccgcccgtttattcatcaaacgtcctaacaatattgaaggggaacatattcatcctatccgtaaaccggaacaactgcctgacttactaaaggaatgtggtttgcccatacctgcgaggttgatgctggagggggatgagttgtcttttacggaatataaccgtttggctgcgtgtttccctgaaacggaggtgcttccttgtggtacggcacttatccggaaggcccgaagtgtcaagactgaaatagagattgagatgttccgtcgttccggcattgcacatgctaaagcttacgaacaaataccctcggtttatagaccaggaatgacagaccgccagttatccatcgaaatagagcgcctgatgcgtctggaaggttgtctgggtatttttcgtaccttcggacaaagtatggagatttttatgggaagtctgctggcaggagacaatgccactgcgcctgccccctatgattttgctctgggaggcgagggacttgacccgtcactgcctatcagtgtgaacggcgcactgttgcagcccggtcagagctttatggttgatatggggggtaacttctatggctatatgggagacatgagccgtgtattctctatcggaaagctgccggaaaaggcatatgttgcccatcaagtttgcctggacatacaagaggctgttgtagaaaaagcgaaaccgggtgctgtttgtgaggacctttacaatctcgctatcgatattgtcaccaaagcaggctttgccgacaactttatgggagccactcaaaaggccaagtttatcggtcatggcatcggtttggaaatcaatgaaatgccggtattggctccgcgtatgaagcaggagttggagccgggtatggtctttgcattggagccgaaaattgttttgccgggcattggtcccgttggtatcgaaaactcttgggttgtaacagcggaaggagtggagaaactgacgttgtgtaaggaagagattgtggaactttgaaaattgataattgataatggataatggaaaattgccatgcggtttcaataaatacgctgcactgtttgtttttccattatccattttccattatttcacccttctgttaagctgattattcgctttcgaaggtttggatttaccaatccgttttccggttggcttggccttgttgcttcgtttgggctttatgccggaatggttactcgccttcataatattcacataagtagtagcgggctataaagtcccaatattgatgcagtgtttcttttcctttcaggaagggaagttccacatcgggtagaattcctttggtcattccgtatttcagcaggtcgaacggacactctccgggttggcagaacatcttgtaaccctctgcagcagcgcgtttggcatcgtacatcgggttatgttcttcacagaaataggcggccacgttgtgggctacgagcatacctttggcgttggcataaatcacgaactctttttggtattccaggtcgggcaatagtgcggaccgtttgttttcccatcccaagacatcgacaaagaaagtgcaaagctccttgtaatcggtgaagtatagcagcggtttcccctggctgtattccagacagcgggcggcatctttactcagtttggtttccggagtgacttccggcagcggagtaatgggcatatccagtaaatcaagtcccattacccaaaggaaggaagattctccctcgctgatgggagcttcttcgaaacgtgcatccatcagttcataggcgctttggcttaatgcaagcaggtctttgttataaggactgaacaaggtgtattccttgtcaaaaatactaaattgtgatttcaatgtccacagtacgaatgcaatgtcttcctgatttatttcatcgggcgtataatcgtcacccagtggatagaacggcaggtaagttccgtatactccttgaaaggcttcggagaaaagtttccagcctccgctttgggcaatggcatcttgaaagtacatgccgagagagatggctgcgtcaatttgggtacgcaggtcttccttgttgaacaagggagaggtcttgacgaggggcaggatgcttgtggcaaagtcgaggtaccatttgtccgttggcagtacgtgggtgcgttcattggcccctaaccaatattgcatgttgattgttgtcatgatttgtttgttttagataaatattatagtctttttaatgccaatttgatgacttgttccaccggtgcgcttggttcttccttcaaaatggcaagcactactttttgtgagggggcttgtgcaaagcccagcatggtaagggcggctacggcttcttcttgtacttgtgcgttggctgccgataccagtgtacctatggtccctgcgttgccggctacaacgctgccggtcttgattttgtcttttaaatccacaattatccgttgggctgttttcagcccgatacccttgactgttttcagtagagtggcgttttccgtgctgatgacatttatcagttcggatggcgagagtgccgagagaatcatgcgggctgtatttccgccgatgcctgaaacggagatgagcagcaggaatagttcgcgttcctgcttgtcggcgaatccgtagaggacataggcgtcttcacggatagcttcgtatatatatagtttgcattctttcttgccctggatggcggcatacgtgttcaatgaaatattgacgccgtatcccagtccgttgcagtctattattgcggttgccggacttagttcggcaattccgcctctgatgtattctatcataattcttttacttgtcggcccaaaatgcgccttgcgtacatatcatctgcgaatgtatgaattattattggactttcactcactaaaaaaagaaaaactgtgtgaaacagcagggagttctgccgatataataaattaaaatgcttacttttgcgccgataaagtagaaaactgataaataaattcataaaaagaatgaaaaaagtaagagcagccatcgttggctatggtaatatcgggcattatgtgctcgaagccctgcaagcagctcccgatttcgaaattgccggtgtagtacgccgtgccggagctgaaaactgtcctgcggaactgagtgcatatcccgttgtgaagaatatcaaggaactgaaaggcgtggatgttgctatcctttgtacgcctacccgcaaagtggaagagtatgcaaaggagatccttgctttaggcattcatactgtggacagtttcgatatccatacgggtatcactgccttgcgccgcacactggatgcagaggctaaaaagcataatacggtatccatcatttctgccggctgggacccgggtagtgactccattgtccgcaccatgctggaagccattgctccgaaaggcattacctatactaattttggtccgggcatgagcatgggacataccgtggctgtaaaggccatcgaaggtgtgaaagccgccctttccatgactattcctacaggaaccggcattcaccgtcgtatggtgtacatcgagttgaaggatggctacgaatttgacaaggtgactgcagccatcaaagccgacccgtactttgtgaatgacgaaacacatgtaaaattggttccgagtgtggatgcactgctcgatatgggtcatggggtaaacctgacccgtaaaggtgtgtctggcaagacgcagaaccagctatttgagttcaacatgcgtatcaacaatcctgccctcacggcacaagtgctggtatgtgtggcgcgtgccgctatgcgtcagcagcctggttgctatacaatggttgaagttccggtaatagacctgcttccgggcgaccgcgaagagtggatcggccatttggtataagacacaaaaaaaacagatgatgtgtttggttcaaacgcatcgtctgcttgccccgaatacatcatctgtttgatgcaaacgcatcatccgttctaccgcgaatggatgatgcgtttttttatgtcttgttctttaaaagaaatacctcagtatatcattgaagtttgcccaaatcagcaaaccgaacaagaggaacatgcccaccatctgcgcacgttccataaacttgtcgctgggcttgcggcgtgcaatgatttcgtaaatgaggaataacacgtgtccgccgtccaatgcagggatgggcagaatattcataaaggcaaggatgatggagaggaatgccgtcatgtaccagaactggtgccagtcccacgtggcggggaaaatactgccgatggttccgaaacctccgagttgcttggctccttccttggagaagagatatttcatctggcctacgtagcctttcagagtctttacccccaaagatacgccggcagggaaagaggaaagaaaactgtattccttgcggacaacgggcagcagtttgtcggttgccgtacgtgctgctacgcctatttcatagtcggcattggtcatcatgctcaaggtgtctgtcacaccgttacggacgtatgtcaaggttacctcatgggatgcattggctttcttgcgcttcagcatctcttctttgaagtcgtagtaggctattgactttccatccaagtgggtgatgctgtcacctacttgcagaccggcggaagcggcagggtatcctacaatcaggctgtcgactacataagggaaacggaaactggcgaaacgcacgctgtctgccagcaagcggttcatcatgtcttcggggatgtagactgaagcagcttccccatcacgcaatacgcttacctggcgagcatcgacaatactggtcagcaggtcgccatcatagcgttcgaacggtaccccgtcggcagatattaggatatcgccgtcgcggaagcctatggctttggctgtttcgttaaaatccatacccaatggggctttttgtactggtatatattcgtcgccccaagtaaaaagtatcatggaatagatgaacaatgcgagcaggaagttgaacaatacaccgcctaccataattagcaggcgctgccatgccggcttggcacggaactcccatggctgcatgggttgcttcatctgttcggtatccatagattcgtctatcatacctgctatttttacataaccacctaagggtagccacccgataccatattccgtgtcactgtgtttgggcttgaacttgaataatgtgaaccaagggtcaaagaataagcagaacttttctacccgcgtcttgaacagacgcgcaaaaaggaagtgccccccctcatgaacaataacgagcaacgagaggctcataatgagttgcagggcacgaatcaagaatgtttccatctaattatttgctgttttacgatttttataattttcgcaaaggtacgttttcttatttaacgtatcaaatgagtagatgttttttataattcttttcattccggtgtatctatcaaatcagctcttctgctatccgtcgggcttcggcatccgtagccacatagtcttcataggtgggcttctgtaagtaggatacgcgcgacatggtcttttctattacttcactcatgccaaggaacgaaattttgtcctgcaggaaggcagctaccaccacttcattggcggcattgacaatgcaaggcatattgcctgcacgatgtagcgcttcgtaggccagggcgaggttacggaaacgggtggtgtccggttgctcgaacgtcagttccgtgcacagcttgaagtccaggcgcgggaaagaggctttcaaccggtcgggataggagaaggcatattggatgggcaggcgcatgtccggcattcccagttgtgctttcacggcaccgtcctcaaactgtaccatggagtggatgacggattgcgggtgtaccacgacttctatctggtcgggacgtacaccgaacagccatttggcttcgattacctcgaaccctttgttcatcatggaagcagagtctatcgtgattttggcgcccatgtcccagttggggtgtttcagtgcttgcgctttggtgacggttgttagttgctccatagtgcaggtgcggaacggacctccggaggcagtcagtatcactttttctatttggttgcctatctcaccggccaggcactggaaaacggcggagtgctcggagtcgacgggtaggatggggacaccgctgaagcgtgccaggtcattgatgagctctcccgccaccaccagcgtctctttgttggcaagggctatcggcttacgggctcggatggcattcatggtgggcttcagccctgcatatcccaccatggcggtcaataccatatcaatgggattttcggtcacaatctggcagagggcatctgcgccggcatataccttgataggtaggtcggcaagcgcttctttcagttgcgtgtatttcgattcgttggctattaccactgcctcaggcttgaatctgcgtgcctgggctatgagttcctctacgcggttattggcggtcaatacgtatgcttcgtactggtcgggatgttcttcgatgacctgcaacgcttgtgtaccgatggaaccggtagaaccgagtatggcaatctgtttcatttactattatgctatttacaatttactatttggagactaaaatacgatgtaaagctcgggatttacggccctgcccttatgccacagctcgaagtgaaggtggggaccggtggacagctcgccggtgtttcctaccagtgcgatggcttcaccccctttcaccgcatcgccttcccgtttcagcagagagccgcaatgcttgtagactgacacgaagtcctggttgtgctgtatttctatcagataacccgtctcggcagtgtaggtactcagtatgacggtaccgtctaaggtggccaatacgctttcgcccggattggcggcaatgtccgtgccgaagtgttttgtttcggcattgaagggagatgaaatcatgccgcgtgtggggcggtagaaaatcagtccgtctatttcggggcgagcggtgatgctcgtcaggttgtacttttctgtctcctcgtactgtttgcggaattcggcttcccgttgtgtacgttccatgagcgaatcttcgcgcaggtgggtcaacgagtcgatggaatgtatggtatctgcctttatcttgccctggaagatgtcctggatattcatgatatagaggttctgtctgttcaccagttgctggagggaatctacgcgcaaggcattctccactacctgggcacggatttcactgttcatatatcccggcaggtagttgcgcagcggggtgaaggctacgatcagggaggcgatgagaaacaatacgaacagcacggagagcaatacggacagtccgttcagcttggatacgcgcaacgtgatgatatcctcaagggtattctcgttcgtaatcgtcagtctgtacttgaacttgatgttactccaaaatgcttttcttcgtttctttttcatacctcttctgttttgtccaaagctatcaaaccttccggcaggtctacggtgatgaccttgtgcttctggtcaatgtctatgataaactcttcttgtgccggcaccagcagttcttctccctgataatctaccacaaacagtgtgttgatggtcgatgtgtccacgtccgtcacttctcccagcgtgccgtgatgtacttcctccatacgaaaaccgacgaagaagtcccaactcagttcacctggtcctgcctcttctgcatgctttacggggaagtagacctcaatattagtgaacatgcgggcgcgttctgccgtgtccacgccttctagtttgacaagggcggtggtgtcggagcggaaacggtattcttccaagaagaaaggcaccagtataccatccagcaggcagattaggtattcggcttccacccggtcgaagatgtcatccgtaaaagtgaacgatagttctccgtgaatgccgtggggcttgttgaatatacctatcttatatacttcttctctctttatcatcttattctattcttgttattcttgctccgagcgcattcagtcgcccttcgatgttctgatacccacggtctatctgctctatgttgtggatgcggctgatgccgtccgcactcatggcagctatcagcagggcgatgcccgcacggatatcgggcgaggtcatgttgccgccacgtagtttaaagccgtggtcgtgaccgatgacaacggcgcggtgcgggtcgcagaggataatttgcgctcccatatctatcagcttgtccacaaagaacaaacggctttcgaacattttctgatgaatgagtacactaccttttgcctgggtggcaaccaccagcagcacactgagcaagtctggtgtcagtccgggccagggtgcgtcggcaatggtcatgatggagccgtcgataaaggactctatctggtacgtctcttgtgcgggcacgtaaatgtcgtcttcccactgctccatcttgatgccgagtcgacggaaactgtcggggataattcccaagttctcgtaggagacattcttgatggtcagttcgctacgggtcatggctgccatgccaatgaaactgcccacttcaatcatgtcggggaggatggtatgctcggttccgtgcagctcgtctactccttcgatagtcaggaggttggaggcgatgccttctatcttagctcccatccggttcagcattctgcaaagttgctgcacgtagggttcgcaggcggcgttgtagatggtggtcttgcctttggcaaggacggctgccattacgatattggcagttcccgtaacagatgcctcgtcgagtagcatataactgccatgcagttgtttggctgagatttcgtagatgccacgctcctcattatagacaaagtcggctcctaaattctggataccgataaagtgtgtatccagacggcggcgtcctatcttgtctccgcccggcttggaaatcatggccttgccgaaacgtgccaccatcggccccaccagcatgacggaaccgcgcaggctggaacattttttcaggaacgcgtcactttccagataggcgaaatcaatgttggcagcttgaaagctgtaagtgtcaatgccttttttagatacgctgactcccatatcccgcatcaattggataaggttgttgacgtccagtatgtccgggatattgtgcacagtcacctcttcggcagtgagcaatgtggcgcagataatttgcaacacctcgttttttgctccttgggggtaaatgtcaccggaaagtctgtgtcctccttcgattacaaatgatgccatgaaattagtgattaggggttggtgattagtggtctgcatggtgatgccgcatggcattaatcactaaccactaatcattcaattttagtatttccgtttattgttccggttgttgttccggttattctggttgttcactttcggacggtagttctggtcaatacgttcggccatgagacggacgatactgtctgtcatttgcagttttccgtcagagagttcggtgaggtcatctgaaatcttacggtcatcgacggtatctttgttccatgccatgtagtctttcttcatgtggttacaaatgagcgctatcaagttctgcttctcttctccttccggaaattcgatggctttctttatcagtacttccagtgtacggccatagtggcggtagcggattttggtactggggtaggggatgctctccggcttggtattcagattgtccttgcggataatttcgtacggataatctatatccaattggaagttggccatgatggcaaggtggtcccatagcttatgtttgaagtcgggcacatcgcgcagatggggaaacatgtttcccatgatgttgatgattgtgtttgcgcaacgctggcgttctgcacggtcttcgattgtcagcgcgtggtctaccatattctggatgctgcgaccatattcgggtaggggcatccgtttttgttgagtgttatattgcatctttaattagtgattaatgttcaacgattagtgattagggtttagcgattagtggttagtgattaatgggctacgtagtgataccgcatggtattcatccctaatccctaatcgctaaaccctaaataagtttctttggcgtgccggctacgaattccttcaaatagaagggttcgaaataggccacatccttgaaatcttgttcggctattgccttttctgccaacgggaacatcatgccggcaagcgggcggatgccgtcgatgaagtgtgcattgggatgcgtgattttctctttgcatttggctgcaccgtcaccgaagaaatagacgggatgttgctctaaaaattccaggtaggagttttcgtccacaatatcggctgcaatgtcgcgcaccgatttcaaggcacggtcgtagatggcagcatagacttccatacggcgggcgtcaatcatcgggcagagtaatgcgtcgtcgggtaactcatcgtggtagagcaataccggtacacactggactttcagggtttccagcccgataagtggcaggttacgtccatagcagacaccttttgccatcgacacgccgatacgcaacccggtatacgaaccagggccgcagctcacggcgactgcatccaacggcatggcatggctatcggcaaaggatagcgcctcgtccacaaagattcccaatgaaacggcgtgtgaagggccattcaggtcctctttcttgaaaacgttctgtccatcctcgctcacggctacggagcaggcagaagtggacgtttcaatatgcaagatacatgacataacttttattcttgattttattgtggcaaatttacgtgattattttcactaattaaaataatcgtgtaattttgcgcaaaactataacattatgatacaatctatgacaggctacggcaaagcaaccgtcgaactgcctgataagaaaatcaacgttgaaataaagtcgctcaatagtaaggcaatggacctatctgcccgcattgctccgctttatcgtgagaaggagatggaaatccgtaatgaaatatcacggaaactggagcgcggaaaggtggatttcagcctttggatagaaaagaaagagagtgcggaaagcgccactcccatcaaccagacattggttgagggatattacaagcagatttgtgctatatcagaaaatctaggaatacctgtgccggatgcgacggactggtttgccacgttactccgtatgccggatgtgatgacgaagaatgatacgcaggaactgagtgaggaggaatgggctgtggtctattcggctgtggaaaaggctgtcggtgcgctggtggacttccgtaagcaggaaggagctgcccttgaaaagaagttccgtgagaagatcgccaatatctcccatttgttggagactatcgctccctacgagaaagagcgtgtggccaaagtgaaggagcgtattaccgatgcactggaaaagaccttgagcgtggattatgacaagaaccgtctggagcaggaactcatctactacatcgaaaaactggatgtgaacgaagagaaacagcgtcttggcaatcatctgaaatattttatcaatacgctggaaaccggaaccggacaaggcaagaagttagggttcatcgcccaggagatgggacgcgaaatcaataccttgggcagtaagtccaatcatgcggagatgcagaagattgtcgttcagatgaaagatgaattggagcaaatcaaggaacaagtattgaacgtcatgtagtatcaaatagtaaatcgtcaaatcgtaaataattcgatggcaaaacttatcatattttcagccccttcgggctccggcaagtcaacgattatcaactatctgctgactcaaaatctgaacttggcattttccatctcagcgaccagccgtccgccccgcggaacggagaaagatggagtggagtacttctttctgactcctgacgagttccgtcgtcgcatagccaatgatgaattcctggagtatgaagaggtatatcaggaccgtttttacggaacactgaaggagcaggtggaaaagcaattggctgccggacagaatgtagtgttcgatgtggatgtagtgggtggttgcaatatcaagaaattctatggtgagcgtgctttgtctgttttcattcagccaccttcagtggaggaattgcgcaaacgcttggtggggcgcggaacagatgctcccgaagtgatagagagccgcgtggcgaaagccgaatacgaactgggctttgcaccgaagttcgataccgtgattgtgaacgatgacctggagacagccaaagcggaagcattgaaagtaatctctcaattcttgaacgaatgaaacaacgtggaggagtgtacaaccagttggcaccgaggaggaagaacagcccgaagctgaacaaggctttgttgattattaatagcgttttgttcgtctgctcccttgttgtgggtgtattgtatatacagcatggcgagcctcgttccagtatttcaatgtttcttatctctgtagtgacgattttcaatgcttgggctgcctggcgtgcgttgcaaagacgtcctttgtaaggttgtatatgaataagaataaatgaatataggaatcttcagcggctcgttcaacccgatacacatcggacatttggccctcgccaactatctttgcgaatacggggacctggacgaagtgtggtttatggtcaccccccacaatccgctgaaggaagaaaacgaactgatggatgacaagttacgtttgaagctggtgcagctagccactgagggttatcccaaatttcgcgcttccgattttgaattccatctgcctcggccttcttatacagttcatacgttggatgcgctgaaacgaacttatcctcaacacactttccatcttgtcattggttcggacaactggaggctgttccaccgttggtacaagtcggaacgtattcttgccgaaaatcatcttctggtctatcctcgccccggctatccggtagaggccgcctctttacctcaaaatgtgcggacagtttcttctccgatatttgaaatcagctccacttttatccgtcgggccatggaggaggggaaagacgtacgctacttcctgcatccggcagtgtgcgatgaactcaaacggatgcagaatgaatctttaaactgaaataaatgtctgtatttgtacgtgttttcatatttatttcttatttttgaacgtatcaaccttgaatgcatggaagagttttcttaatacatagatattccttaatttaataatccgcttatgagaaaagaactactgttactgggagcattcggtatgctgacgacagcgacgctttgtgcgcaagagtttcatttgcaacctactccccaagaatatattacgcaaaaagattctgttgatattccccgacaataccagatcctttccggcaattccgtgcaggacggacctgcgttgcctttactccgttcattgatgccggaagaggtgcttggcgcttctttccgtgtatatataggagtgaaaggagataagattattaagaaataccaacatcggattccacgcaaatccgaaggttatttcctgaaaatagaaaaagactgcatcgtcatagccggtgctgacgaacggggagcgtactatggtgtacagactcttgcgcagttgcttgctttagacaagctgcctttggctgaagtgacggactatcccgatgttccctatcggggtgtggtggaagggttttacggtgctccttggagtcaggaggcgcgtatacgccagcttgatttttatggtcggaacaaaatgaatgtctatatctatggaccgaaagacgatccttatcaccggactcccaactggcgcaagccttatcctgctcgagaaggagaagagttgaaagtattggtgaatagggcgaaggagaacaatgttattttctattgggccattcatccgggtcaggatattcgctggaatgaagaagaccgctcgttattgttgcagaagttcgaaagcatgtaccagttgggtgtgcgtggttttgccgttttctttgatgatatttcgggtgaagggacaaaggcggacaagcaggctgaactgttgaactatattgatgaccattttgtaaaagtcaagcgggatgttgcgccgttaatactgtgtcccacggagtataacaagtcatggaccgatgtagaaggaggctatctcactacgcttggtgataagttgaacgagggtatcaaggtgatgtggaccggtgatatggtagttgctactatagataagtctacgctggacttcgtcaatccgctgctgaaacgtaaggcgtacatttggtggaatttccccgtttcggattatgtacaagaccatttgctgctagggccggtttatggaaacgggcttgatataaaagatgatatgtctgcttttgtttccaatccgatggaacatgccgaggcttccaaaatctctctgtacagtgtagctgattatacttggaatatggagaattatgatagtgaaacttcttggaaacatgcagtcagagaccttatgccacttcatgccgaatatttggaaatcttcgctgctcataattccgacccgggacagaatggacatcgtttccgccgtgaagagtccgttgccattcagcctgctctctctgccttgttgaaagcttatcaagagaaaaacgagatagatgaagatgcctatcggcaggtagctgaggaatgccggaagataatcgttgccgctgatggattgcttgcatcgggaaatgagaattgtccgttgataactgaaataaggccttggctcattcagttcaaacaagtgggagagtatggtgcggaggtgctgaacatgatacgcctgcgccagcagaaggatgcatttataggtagctacgaacacgcccgcgccctgctggtgctgatgggtgagacggatgcccaatataaagcgggcataaagagcggcagcctgcatctgatgcctactttcaatgctttgttcgaagcggcgacaacgggctataatgcagcgttccatgccgggcttgatacaaaggctgtttattctccctacacgttgaagagcgacgtgaatcagttggcttcgcttcctattcagcagaagggaaaggtgaatacaattattccgtccaatgaagtcatcaactggcaggcaggcggtgtgctgaccatttcgatggattatgcccgccagttgagttcggtgcttatcgatttgggagatgcggaggttactgattcgaagtttaaactggaagtaacttcggatggcacaaactggcaggcggtggatttgaagccgggatacagaacgcaggtgaaggcatctctcaaggagttgagtgttgcgaagatgaggttggtgaatgtatccgacacagagcagaaggtgtatttcaaaatgttccgttttacggagaattgatatggttcctgattcttaaaatagagttacgcgcgtgggacgatgctccccgttgttcttaagatcggaatgacggggagcacttttttaggaagttattcaaggcatttgtccaagtcgcggatgatttgctctttatccatattttgtccgatgaatactatcttcagcatgcggtcgccgtattgttcgtcccagtctcttagcaatcccggctcttggcgcatcagttctatcatgtcttcttcgggagcggtggcataccattgtccggcttcagttattttcttctgtatacctgcttgttcaaagaggaaggacatgtcgcggttgtggctgaagtagcagacacccttggcgcggataacgctgcggggccatttggtagcgacatagtggtcgaacttatgaatgtcgaatgcaggacggcggtagtagacaaatgtgccaataccgtattcttctacttcacctccttcgtgatggtggtgatgacatttctcgtgatgatgttcgctttcatgatgatgttcatcttcgtgatggtaatgcgcctctttttcctcctcttcgcttacttgttgctctatgccacgaatccatccggcggaagttgcggcacgttcaaagttaaagaggtgggtatggataatcttatccaggtctacatctgcatagttgcactctataatttgggcaccgggttgcaaggtgtggataatctgcctgatacgttttaattcctcgggctgtacttctgctgctttgttcagcaggataatattgcagaactcaatctgctgaatgatgaggttttctatatcttcctcatcaatgcctttgcgtgtcaaatcatctccgcaagaaaattcactttgcagacgtaaggcgtccaccacggtggtaatgcagtctaagcggcaaataccgtatttagtatacgctcctcccatatgaggaatggagcagagtgtttgggcaataggctccggttcacagatgccactcgcttcaatcacgatgtagtcgaagcgttgcatcttcatgatttcgaacatctgctctatcaagtctgtcttcagcgtacagcagatacagccattctgcagagctaccaggctgtcgtctttctttcccaccacgccacctttctgtataaggtctgcatcaatgttcacttcgcctatgtcattgacgataacggcaaacttaatgccacgtttattagaaaggatgtgatttaccaacgtcgttttgccactacccagataaccggtcaacagcagtacggggatttctattgtattcataatcgtttgattttattcaatgatgatggtcttctttcattaacttctgcaaaagtatctgatttatgtgacaatggattggaaaagagacaaatttttgtttcttctatattatctaaacagaaaaaaggtgaaaagctttgagcttctcacctttcttctgttatagttgtactatggctttagtccttacacaattccttgtgccatcatagccttcgccaccttcataaatccggccacattggcacccttcacgtaatttacatagccgtcggcttctgtaccatattgcacgcaagcttcgtgaatgttcttcatgatgctcttcagtttctcgtccacttcctctgcactccagctcaacttgatggcgttctgagtcatttcgagaccagatactgatacaccgccagcattggctgccttacccggagcatacagaatctttgcatcctgaaataccttgatggcttccggtgtagagggcatgttggcgccttcggatactgccattaccccattagctatcaactgacgggcatggtcgccattcaattcattctgagtggcagaaggcaaagcgatatcagccttttcgccccaaggcttggctccttccacatatttcacacccggatattgttcagcatattcgcggatacgtccacgatagaggtttttcagctccatgatgtaatccaacttttcgcggtcaatgccgtccggatcgtatacataaccgtcagaatcagacatggtcaataccttgccacccaattccaatactttctcggccgtatattgagctacgttaccggaaccggaaatcagacaagttttgcctttcaggtcagtacccttagtcttcaacatttccatcaagaagtagatgttaccgtagccggtagcttccggacgaatcagcgaaccgccgaactcacggcccttaccggtgaaagtacccgtaaattcatgagccagcttcttatacataccgaacatgaaacctacttcgcgaccacctacaccgatatcaccggcaggtacgtctgtttcaggaccgatatgacgccacaactccagcatgaaagcctgaacgaaacgcataacctcagcattcgacttgccgcgcggagagaagtccgaaccgcctttaccgccacccatgggcagagttgtcaatgagtttttaaatgtctgctcgaaagcaaggaatttcaggatgctcaggtttacagaagcgtggaaacgaacaccgcctttataagggccgatagcgttgttgtgctgcacacgatagcccatgttggtttgtacgttacctttatcgtctacccaagtaacacggaattggtaaacgcgatcggggatgcaaagacgttcaatcagattggctttgtcaaactccggatgcttgttatactcttcttcaatcgtagaaagaacttcttctactgcttgatgatactccggttcgttggggaaccgtcttttcaggtcttctaataccttagctgcattcataatctatttcttttattggttgctactatatgttacctaaaacaattcgattttcggtttgtttccttttcctctcattgcggttgcaaaagtacacataaaaatgaaacgagcaaacattttataaagaaaatgcggtataaaacaacaattttattgttttataccgcaaaatggaataaaaagatattatttatcctctttttagagactttatgacgggaataaatactaaagccgccgaaatggcaagcgttaggataattggaccgtcaattcgttcgacagatatcaaaacaatgtagcaaagtgctgcccaaagcagcacaatgcaaactatttggaattttgataacggtcgtctcatttggcagccttctttttgtctacgatagcatcgataactgctactgcagtgatgttaacgatatcgcgcacggagctctcaaaatcggtaaagtggataggcttgttcaatcccatttggataggaccaatcagttcggagtccgtatccatcgcctgcaacagcttgtaagcagagtttgcagaactcaagttcgggaaaatcagtgtgtttacgtcttttcctttcaagcgcgtaaacggatacttggcatcacgcatttcgcggttcatggcgaaattcacctgcatttctccgtcaatggcaaggtcaggatagttttgttgcatataatccacagcttcgtgtacacttaccgggctgccttctttatccgcaccgaagttggagtaactcaacatggccattaccggtgtatgattaaagaagcggacggtatattccgacagcttggcaatatcgattagcgtttcggcattgggatgacggttaatcagcgtatcggccaggaagtatgtaccttttttggagttcaggatatgcatggtgccgaaatgcttgtattccggacggatgccgatgacttccttggcaaccttgatggtattgctgtatttggtgtaaagacctgtgatgaaagcgtctgcttcacccgtttccaccatcatcataccaaagtagttacgttcgaacattttgtcattggcttcttcgtaagtgacgccttcgcgggcacgtttttcggatagaatgcgggcatagcgttcacggcgcggcgcttcatccggatgacgcagatttactatctcaataccttcaaggctaaggtctagttcttttgccagcttctcgatagcttcgtcgttgcccaatataataggatgacagataccttcagccttggcttccacagcagctttcagcatattggggtggatgccttcggcaaataccacacgttgcgggttgcggcgggcggtgtcgtagagttggcgggtcagtttgctttcgtaacccatcagctcgcgcagttgcaggcggtaggcatcccagtcttcgatgtctttgcgggctacaccgctttccatggcggctttggccacagcgcaggacacttcggtgatgaggcgcgggtcaaccggtttcgggatgaagtattcgggaccgaaggtgaagttgtttacatggtatgcttcattcacaacatcgggcacgggctgcttggcaaggttggcaatggcgtgcacggcagcaattttcatggcttcgttgatggcttttgcctgcgtgtcgagggcgccgcggaagatgtaggggaaaccgattacattattaatctggttaggatagtcggaacgaccggtggacatcagtacgtccggacgtgctgccatggcgtcttcgtaagagatttccggagtagggttggcaagggcaaacacgatgggatggtctgccatgctgcgaaccatgtcctgggtcaacacattaccttttgacagtccaaggaatacatcggcacctttgatggcttctgccagtgtatgtacgtcgcgacggtcggtggcaaagtaacgtttctgctcggtcagattctcgcggtcgctggtgatgactcccttactgtccagcattaggatattttcacggcgtgcaccgagcgcttcatacagtttggtacatgaggtggcggaagccccggcaccgtttacgacgattttcacttcctctatcttcttgcctgccacttccagggcgttcagcaatcctgcgctggagatgatggcggtgccgtgctggtcgtcgtgcatcacggggatgtccaattcctctttcaggcggcgttctatttcgaaacattcgggtgctttgatgtcttccaagttgatacctccgaatgttggggcaatagccttgacagcttcgatgaacttgtcggggtctttttcatttacttcgatgtcgaatacgtcgataccggcataaattttgaacaacagacctttaccctccatgacgggtttgccgctgagggcaccgatatcgcccaggccgagcacggcggttccgttggagatgacagctaccagattgccttttgctgtatatttatatgcatcttgcgggtttttctcaatctcgaggcacggttctgcaacgcccggagagtaggcgagagaaagatcggtttgtgtactgtaaggcttggtgggtactacttcaatcttacccggtttgccttgcgaatggtagagcaaggctgcttctttggttattttagccatggtagaatagttaaattggttataatttggctgcaaatgtaggtataaaagttctaaattgtagctcgctgtcaataaaatctattacttttatcagttaattagcttaaaatgcttatttttggcatcagattttagagattacccccatttattaacttaacacatgagttgcatgagaattttgaaacttcctctggcaggattattattttgtgtaatggcactatttgctggatgtaaaacgagtaatgaacctaaggcaccggttgctctgacctgggaaatgggtgcaagtgacatcgaacccggatattatgagaatacctttattctcaagaatatctctcaaaaacctctaaaaaagaactggacgatttactattcacagcttccccgaggggtgaagcaggaaggagcctctgaagtgaaggtagaggtagtgaacggtaattttttcaaaatgtatccgacagacgaatttgctccgctggctcccggtgattccatgcggatcactttcctttgcacttacaagctggaccggaactcccatgtaccggaaggaacttattgggtggagactgtggatggtaaagagggcagtccgttgcccgtggctttgaaggcgctgccgcttccttctcccgagtcaatgagcggctatccggatgcgactaagatttatgaatccaatcttcgcttggctggtgctcctgctttggtgcagtcagacattcttccgtctgtaaagaaagtggtagccattgaaggcgataatgtcgtattggaaggtaaggtagctttggcatttccggagaactttgccggtgaagccaagttgctgaaagagaaactgactggtttgtatggtttggaagttgtcggaaatgcttccgtgaagattgtgctggaagaactgcttgataggaaggaggccgtaaatgatgaatattatactatcaatataggtgacaacctgataaaaatcagtgctgccactcctcatggcatttttaatggtacacagacacttttgtcaatgttgaagggcaagcagacaccttatttgctggaggcagtctccattcgggattatccggacttggcatatcgtggacaaatgatagatattgcccgtaatttcaccgctccggagaacttgaagaaactggtggatatttttgcatcttataaattgaatgtcctgcatttccatttttgtgatgatgaagcctggcgtttggagattcccggtttggaggaactgactactgtgggtagccgtcgcgggcataccactgacgaaagccagtgcctctacccatgttatgacggtggctatgcccctgatgcaaagactgtaggcaatggatattatagccgcgaggaatttattgatttgctgaagtatgctgccgaaagacatgtccgcattgttccggaaatagaatctccggggcatgcccgcgctgccattgtctccatgaaggcacgctataacaaatattttgaaactgatccgggaaaagctacagaatatatattgagtgaaccggaagatacttcacgttatgtttctgtacaatattatacggacaatgtgatgaatgtcgccttgccttctacctaccgttttatggagaaggtgattcaggaacttaatgcgatgtatcaggaagccggtctttcattgtccacagtgcatttgggtggtgacgaagtgcctcgcggcgtgtggatgggctctccgaaatgccaagagctgatgaaggaaaaaggcatgacgaaagctcatgatttgtcggagtatttcattacgcaaatggcagatgtgatgcagaagaacggactgaaattcagtggttggcaggaagttgctttggggcataccgaagaggctcatcaacagttgaggggccaggctgccggtgtgtattgctggaatactgtaccgggctctgatgaagtggtttatcagacagccaataacggttacccggtcatcctttgcaacgtgggcaatttctatatggatatggcttacaatggtcatccggacgagcgtggactcgattggggaggttatgtggatgagtctgtctctttctctatgcttcctttcagcatttatcgttcgctgcgtgtggatatggcaggcaatcccattgatttgaataatgcggaaaaggggaagactgctttgacagagataggcaagaaacatattatgggtgtacaagggcaattattcgccgaaactatccgtagttttgatggcgtggaatatcttctcttcccgaaaatcttagggctggcagaacgtggctggaatgctcatccggtatgggaaaacctgtccggcgtgcgggagcagcaggctttcaatcaggctttggcactttattatgagaaaatcagcaagagtgaaatgccttattgggcaaagcatgggattaacttccgcttgcctcagccgggattattggtaaaagatggaaatctgtatgctaatgtggccattgatggggctgagatacgttatacgactgatgggtcggaacctactgcccagtcaaccttatggaaagaaccggtgaagtgtggttccctggtcgtgaaagcaaagaccttctaccaaggcaaggaaagtttgacgattatattgaatgttgagtaatagagaatattgaaatgaaaagggagtgcattgtccgaaaatgcactcccttttgtttattcctttaggcgttcagcgcttgttctatatccgcaataatatcctctgcattctctatacctaccgagaagcgaatcaggtcggggcgtacacctgcctccatcagttgctcgtctgtcaactggcggtgtgtatggctggctgggtgtagcacgcaagtacgtgcatcggccacatgagtcacaatggccgccagtttcagtgaatccataaacttgatagactcttcccgtccgcccttcaagccgaaggtgacaacgccgcaagagccgttcggcatgtacttctgtgcctgctcgtagtatttgtcgcccggcagaccacaataattcacccaagccactttatcgttctgggcaagatactcggctaccgcttgtgcattcttgcaatgttggggcatacgcaggtgcagtgtttccagacccaggttcagcaggaatgcgttttgtggagactggatgctgcccaggtcgcgcatcagttgggctgtagccttggtgatgtaagccattttgccgaaggctttcgtataagtcagtccgtggtaagactcgtccggggtgcacagtccggggaatttgtcggcgtgtgcatcccaatcgaagttaccgctgtctacaatggctccacctacgctggtggcatgtccgtccatgtatttggtggtagagtgtactacgatgtcggcaccccactcaaacgggcggcagttgataggggtagggaaggtgttgtccacaatcaagggcacgccgtggctgtgggcaatgcgtgcaaacttctctatatcgagcacttcgagcgtagggttggagatggtttcaccgaatagggccttggtattggggcggaaagcaacggaaatttcttcctcgctggcatccgggttgacgaaagtgacgtcgatgcccaatttcttcaaagttactccgaagaggttgaatgttccgccatagatggtagaggagcaaacaaaatggtctcctgcctggcagatattgaaaatggcatagaagttggctgcttgtccgctggatgtcagcatagcggccacaccaccttcgagggcggcaatcttggcggctactgcatcgtttgtaggattctgcaggcgggtatagaaatagccgctgtcttcaaggtcgaacaagcgtgccatctgttcgctggtatcatatttgaaagttgtactttgatagatggggagtacacggggctcgccctttttaggagtccatccggcttgtacgcacagcgtctccggcttgaattgctttgccataatgttatctgttttaaaagtttcttatctattatcgcgtaagttgtcgcaaaagtagggaaaaaattataattttgtgcttaagtatggtaaaatgctataaattagcggctggaaatttgtagcgaaccgaataaatgatgaataattggaatatgaaacgcatattttgtttactgaccatcctcttttgtactttgtttgcttttaatgcttcggctcaggaagagcgggatagtccgagacgtggagaaggaatctctgttttcctggaacgtaacaagcgcccggggagagcctattataaggagtttttggagctgaacaagaaacttcttaaagggaaggaggaattgcggctgggagtgaagtatgtactgcccccattatcaaagccggttggcaatgggaagaagacaatcaatgaacctttgttcgggaaagcgcttgccagtgtaaaagtgacatctaaccgtttgcagggcgcttgtttttatgtagtgagcggacatggaggccccgaccccggagctatcggcagaatcggcaaaatagaactgcatgaagatgagtatgcgtatgatgtggctttgcgccttgcccgtaacttgatgcaagagggggcggaagtccgtatcattatccaggatgctaaagacggaatccgtgatgacaagtacctttccaacagcaaacgtgagacgtgcatgggagctcccatacccttgaaccaagtggcacgtctccggcaacgttgcgccaaaatcaatgagttttacaagaaggatcgcaagaactataaatattgccgtgccattttccttcatgtggacagtcgcagcaagagccatcagaccgatgtgttcttttaccactctaaaagcaagcccgacagcaagcgtctggctaagaccatgaagaaaactttcgaatcgaaatatgacaagcaccagcccaaccgtgggtttaccggaactgtcagcgcacgcaatctttatgtgttagccaatacttctcccgcttccgtattcgtggaattgggaaatatccagaacacttttgaccagcgccgttttgtaatcagttcgaaccgccaggccttggccaagtggatgatggagggtttcatcacggattataaaaaggcgaaataaggacaatcaactctggctctcctttttcttttcgtgtaccaccacgactgtaacggccgttattatcagcgccatgccgacgacgctggccggtgtgaagctttcattgaatatcaggcaaccgataactacggctgtcagaggttccaaggccccgaaaatggaagtcagtgtaggccctatgtatttaatggcttttaccagggtgatgttggatatagctgttgccagcagcgccagtccgagaatattcagccatgtgtaggtatcattgaccagccggatgcctccggtcagatatcctcctataataaagaacaaggctcccagccccattacgtagcatgtcaatgcagtggagggaatctgcacggcacggctcttccttactcctacgatatatcctccataaaagaatacggacagaccggcagcaatcagcccgatggtcgtgtttcctccttcaaagtctattttgccggatgacaaaagtccagctccgcttagtgacaccaacacggcaaacagaatggcgaatgacctcttttctccgaaaaagcccatcatggccagtgccacggccagcggatacatgaaatgaatggtggatgccactccgctggatatgttctgataggcgatgaccagactgaaggaggtagctgctcggagcaggctgaggatgaacaccgttccccagtctttcctgctgatgcggaatgtctcgcccagcataatgccgaaaacgaccaaggtaagtgaagctattccccatcggtaggccaatacttcgaaagaggagaagcccgcaaggagtaatgaaatggtgaagaaaggagccagcccgaaggtggcagaggagagagccgtatatataaacccttttatggagacattttgcattttttatcttgattttaatggagattttaaaattatctgtttgcgtcaattgcttgattcgcattgcgtcgtgcaaaattaatgaataaaaacaagcatacagacaagggagtgtcccttttttacaatacagtatagatatgggtatctaatatagtatcgaccggcttgcctaatatttattcgttccatcatgaggtaaaaatcattccaccgcggagtaaaaatcgttccaccatggtggaacgatttttactccatggaggaacgaatacttgttcgctgtccggctcctaaactcttccggggagaaagtctgatagctccggcagaacagtttgcctactctaccggaatataaatctctgtcaacagttcctccggcgccgtatctgcggggttgttcaggtaacgttccgcactggactcatcccgtaagctacattccatttcggggatatacttcccgtagatggtatcgtatacggcctgcagatgttcgtatggacctttgtataggaatatggcatagcggcctgccgcgagctgtttaaatcctatgtctcctttggccgttgcaaatgagggtaggaccatacatacatcggtacgcagcttttcagcgggtgtcactttggggtcatcgtgatagatacagtagggcatcacttctcccataggcagtttttcttcctggatgaactggcaaaggcgcatccatgcgctgcaatagtcgttcagtttatagtcgccaaagaggcggaggtaaattacatttcgggcaggaacttctttgatttcgtgtttcagttccagttccggacgaataatggctggtttcataattacaaagtttttattgttacgatactctaatggtgaaatgccatagaactgcttgaatacttttgacagtgacgagggcgaagagtagcctatacggtaggctatgtccgctatcggcatgtccgagtaacgaagcaaccgggcagcggcttcggtacgcgtccggacaatgaacgtaccgacgggttcacccagaaaagctttcatgatgcggtggaaatagaagggagagaaatgggaaatcctggccaaagatttcaggtcaatttcttctccgaggtgcagatttatataatccactactgcgttcacgcacttttggtattcctcctgggttgtctttttctgttgcatggttctattgggctttttcatgttgcaaaaataggaggaaaagaaataggttacttgtccgatgttgctataaatgcaatatctttaaataagataaactatatcccggcacaactttttcgtgcaagcatgaaagttttgcattcgatttgcaatatctttgcatttcagatgaaaaaacaaatgcttgcagatgaccgaggagattaaaagacaactttgggagtgggcggcggcctatcattgcgccggcttcattcagaacgaccccgtacagtttccacatcgctatgaacggaggcaggatattgaaatcagtgggctgctgactgctatcatgagtttcggcaaccgtaagcagatattgaaaaaggctgatgagttgcataggttgatgggggtatcgcctcatcaatacgtattatcttgccaatggaagaaagacttccctgctacggacagaagcagtttttaccgaatgctttcttatgctgactttcattcctatttcaggcgtttgcatgctgcctattctgcttttgacagtctggaggatgccttatgtacgtatgccggtaatccgatggaaaggttatgtgcgtttttggaagtctcggcaaagagtccccaaaagaaactgaacatgtttttgcgctggatgataaggaaaggtccggaagtggattttggtatttgggagagatttgattgcagggacctgattgtgcctttggacacgcatgtctgccgtgtggcctatgctttgggactcaccgagacagaaacattttctttgaagaatgcccgccggattactgaagctctggcagaggcctttccggacgacccgtgcctgggggactttgctttgtttggaagcggagtcagcggagtattgtagcgtgttaccagtcaatttcttgtatccctctgctccgtaagaaatcgttggctttactgaagtgcctgcaaccgaagaatccgtattcggcagaacgtggggacggatggacggtagtcagaatcaagtgtctgctgctattgattaaagcggctttctctttggcgtacgccccccaaagcatgaatacaagattctcccgttcatcactcagtttcttgataacagcgtctgtgaaggtttcccatcccatgttccggtgcgagccggtttcgtgggcacgtactgtgaggacggaattcataggaaacacgccttgcgctacccaacggtccagatttccggaagtcggaatgggctttcccaagtcctgatgtatttccttgaatatgtttgccagagaaccgggaatggctattcctttcggtacggaaaagcagactccataatactgaccgggattaggataagggtcttgtccgaggatgacgactttcactttctcgaacgggcaagagttgaagacgtggaaaatttgatggccgggaggtagcacgttggcatgtccatactcactttttacaaatgctaccagcttctcaaaataaggtttgtcaaactcctcttgtaggcgttttctccagctttcttctatttttacgttcataagagtcttgcagttacatatgaataggaaacgatgttgcaaaaatacaaataatccggatgaggcagatgcatttacgagtataaagaatgttttaattatcgtatgaaacgatagttattttgagtaagtttattacttttgtggtgcaatgccggacactaagcatagagtcgccattgctgaggttgaactgattggtaaaataaaggaatggaaaattttcatcgtatggatgcttgtccggtacgggatgtactgagcaggttgggagacaaatggacaatgcttgtgctggtcacactgaaagcgaatggaacgatgcgtttttgcgatatacagaaaaccataggggatatttcccagcggatgctgacggttacattgcgctcattggagacggacgggctgattgtcaggaaagtctatgcggaagttcctccccgtgtggagtataaccttacagaaatcggatgtagcctgatgccgcatattgaatctttggtaggatgggcattggagcatatgaatgatattttgaatcggcgcagtctgcagaactgatgggtcgatatgcaaagagggtgtgtcgaaactggtattcaccacagattacacagatttgcacagataagcatctttgattatcagtagattaagctcattctgtgttaatccgtgtaatctgtggtgaattttgacacaccccttcagaagtttccaagtgcttgttttatttcttagcatcggcaaaattgtgaaccttgtttttcagattgtcagctttctctgcggcctcatgggcctcatgggccatcttgtctgctactttggtgccaacgtgcaatgcttcttcttcagcagtgttgatgaactccttggcttcgccatttgctttgtggatggcacggcatatggcatcttccagctttttagctttctccgtacgggagaagtggtaggccaatgcaccggcaaccgaacctattcccagtccgatccagaaattagaatctttacatttcataatcaagtcagtttttaatagttaaagttagaatcaattctgatgagacaacatacttgccaaagattggttcatccggcgggaaaggaattaataacaatttacttttgttggtggagatatttattctgcttaaatttgcgatgcacttaaaatttatacaagtatgattagattaaatgtttttattcaggtaagtgcggagaaccgtgccgcagtattggaatctgccaaagaactggtcgcatattccttgaaggacaatggatgcattgcttatgatgtgtttgagagcgccactcgcagcgatgttcttatgatttgtgaaacatggaaagatgcagagtcattgtctgcccatgaaaaagcagaccattttgtggccctggtgcccaaaatccaggggctggctgccatgaagttggaaaaattcgagttctgaatcagtaatttgaggtagtaaggggttgtgtgatcatgcgtaaataagtatatttgtgcattcttaatatacatatttatgctgattacccttattatccttgttctctccgctgccttttttgtagcaggcaaagtccgttcggacattgtggcgctttgtgcgctgattggtttattgatatttcagattcttactcctgaagaggccctttccggcttctccaactcggtggtgattatgatggtgggcttgttcgttgtgggcggcgccatttttcagaccgggctggctaaaatgataagttcgcgcattttaaagctggcaggcaagagcgagctgaaactcttcttgctggtgatgctggttacctctgccattggtgcttttgtgagcaatacgggaacggtggctttgatgctgcctatcgtggtgagcttggcgctgagtgccggaatgaatcccagccgtctattgatgcctttggcttttgccagcagtatgggcggtatgatgacacttatcggtacgcctcctaacttggtcattcagaatacattgacgggagcgggctttgaaccgctgtctttcttctccttcttgccggtgggcattgtgtgcgtgatagtgggaactttggttttaatgcctctgaccaaatggtttctctccaagaaaggcaaaaagaatgacggaacattgtcgggtaaatcattggaccaactggtacaggagtacggactttccagcaacctgttccgtttgagggctgtcaatgattcccgtctgataggaaaaaccatcatagacctggatgtacgccgcaagtatggtctgaatatcattgaagtacggcgtgtagactcttcccaacatagattcctgaaaactattacccagaaattggcatcacccgatacgactatttgggtgggcgacgtgctttacattacgggagaggtgtcgaacgtaaatcgttttgctgaagactttttaatggaaatgctcgacgggcataccactgaagaagcctccaaagccgacaagtcccttgacttttatgacatcggaattgccgaaatcgtgttgatgccttcttccaatatcgtgaaccggacggtgaaggaagcggggttccgtgataaatttaatgtaaatgtattgggcatccgtcgtaagaaggaatatatattacgtgaattgggacgtgagcgtatgcatagtggcgatgttttgctggtgcagggtgcgtggcaggacatcgcacggataagcagggaagattccgattgggtggtattggggcagcctttggcagaagctgccaaagtgacgctggattataaagcgcccatagctgccgctatcatggtgctgatggttgccatgatggtcttcgactttattcccgtggccccggtgacagcggtgatgattgccggcttgctgatggtgctgacgggatgtttcaggaatgtggaagccgcctataaaacgataaactgggaaacaattgtactctttgcagccatgctccccatgtctcttgcactcgaaaaaaccggtgcctcggaatatatatccaacagtcttgtaagtggattgggcagttatggtcctattgtgttgatggcaggtatctatttcaccacttcattgatgaccatgttcatcagcaatacggtgacggcagtgctgatggcccctattgctcttcaaagtgcgattcagattggagtaagtcccgttccgttcttgtttgccgtgacggttgcggtaagcatgtgtttcgcttctccgttctctacaccgcccaatgcactggtgatgccggcaggacaatatacattcatggattatataaaagtggggctcccgacgcagcatattagactaattgactaccaatagtttgaaacttaaacggtaggaaagtctgattttgctctttattcttcgctgaacttttgcaaagataatgcgtttttccggtacaaggaaaacaaatgaaaagactttgataaaaaaggtggtttttggtgcaaatttgccagctgtgctatgaggtttacggaagattatgtatagaatttcattgctggcgaaaagaaaataataccagtaagtaagctaattttcttctctccctctatttgacttaactttattgcccgtgtatataataacggtcattaaagtcaagttgagagtggagacatatctttttcttttggcaagcaaaaattcagttattggaaattttcgaataactgaatttttaaagccccaacatatcatataatatacaaaaaggagcatttttagttactatatgatatattgaggctttagcgtattgctgacgagttcatgcctcacatcaccttacattgtaagcgtctccagatttacgtcttgacgtctgcatctgcctgattttcctttgtgcttcattaaaattatgtagatatggaagcacaatgtaatcacactcctgagttagcaagtatccgctatacgcgtgtctgggctgatttttctgcattggtgcagagtggtcaggcgacaactctctcatcatattgccgtattacgcatactagttatgagggtatcaagtattggctccgtacaaagggtctgtctgtaaaatcacttaagaagtctaattgcacgcgagatacagcattgattgctggttcctccgagattaagcctgtctcgtttattcagtttgcaccctcatccgcaccgatgccttcagcagccatgcgaggcaacagcatcaccttcccggacggagtgaacctgtcgcttcaagaaggcactgcagagggtattgcagatttattggcaatctatcgcagccactgtaggatggtaggaggtatgtgatgttcgggctatcaaacaatgtgagttacttcatgtgccagcatcccgtgaacatgagcaagggaatagactccctgttcaatctgattatctcagagtctccactggcaccgatgactggagatgtgttcgtgttcttttccaagaatcgccagtctgtcaagcttctgaagtgggataatgatggttttcttctttatcagaagcatctggagagaggctcgtttgagatgcctcgaaagaatgccgataccggatattatgagctctcctgggagactttctctttcataatgtccggcatctcacttgaaagtgtgcagttccgcaaacgttatagaacacagtttatatgcagataatcttttaattaccaataaaataaatcttaaaaactattacatatctcgtttttcttcgtaccttagatgtatgggaaaggacatgataatcaaacttttggagtctcggctgaaggcgtcgaatgcgacaaacgatcagctgagactcactattgacaacatgtctgccagcatgaatgccatggtcgtgaccatctcagagcttcgcgagactatagcgaatctggagtctctcctgaaagaacgcgacaagagtctcgacaaggccaacaatcaagttcgtggcatgtcaaagcttcttgagaagaagtcagagaaacaagcatctactccagtaactcctaagacagaagaagagattgctcagaaggaagttgagcgcaagtcccgcggtaacaatggtgcaaagcgtaatatgcatttcgagatggagacagtcaagcatgacgtgtatcctgacggcatggaaggacggaagccgctcagtacaagagagactgtccgctatgagatgatacctccaaggttcatcaaacacttgtattatatccacacagtaaaggatggagataagcttgtaagcgcaaaggctcctcttgcacctcttcagaactccagcttcgacgggtcgttcatctcaggcatagcccagctccgttatctgtactcaatgccggtggaacgtatcgtggcgtactttaacgagaacggcttcaatatcgacaaacagaccgctcacgggctgctgaagaagacagcacttctgttcgaaaacttatacaaggcgatgcagaaggcagtcaaagaagataactatctctgctgcgatgagacctaccacagagttctcgtaaagaaggaactgaatgacggcaagggaagccgcaagggttatgtctgggtgattgtagcagcacatctcggcctggcatacttcttctatgatgatggttcaagaagcgaagaggtaatactgaaagagctcaagggatatagcggagcgatacagtcagatggcctgggagcttacaagaaagtcgcagcacagtccggaggaaagatattaagactagcctgtcttcagcattgcaagagagagttcctggacatgaaaggcaatgctgatgcagacaagatactgactctagccaatcagctctatcagaatgaacataagcataagatcggagaagacggctggacggtcaaagataatctgaggtggcgacaggagtatgcgtctcatatactcaggcagatgaaggagatgcttctcaagatcaagtctcaacctcggaaatatcctccaaagtcgcagatgttcaaggccgccaaatacatgctcaacgaatgggatggtatcgaagctataactactggtggagactactcgtgggacaataatctcattgagagaatcaacaggtacatatccttgtccagaaagaattcccttttcttcggcagccatgccggagcagagcgtggctgcatcttctactctctcgcatgttcatgcaggctgcacaagataaacttcttcgagtacctcacagacatacttaacagagcggatgtcttgcagaggtccgccacactggaagcgtacagagatatacttccagaccgctggaaaaagaacaagcagggccagtgaccctgcttttcttatgctgatacggcatcctggagacgcttaccttacattaaattcttttgccatatagaaaaacacttggcttgaaattttgtattatgctgcataatcattatgtttgcaatacataattaatgttgaatatgaacttcgttgatagaatagaagaaacagcacgactgagggatgctctttcaagagagaagtcctcgttggtcgtagtgtacggtcgcaggcgattgggtaagtcaacacttatcaaaagggtgttgtcggacagtgatgtatatttccttgctgaccgttcggaaggacagcaccaaaggactttacttgcaaaggtagtagcacaagtatttcctgattttgacaagttgacttatccggattgggagtctctgtttcgtgcggtcaattatcgcacagacaagcgtttcacgctatgcctggatgaatttccgtatctggtggaacaatccccggaactgccgtcagtgttgcagaaatttgttgatgaaaagcagttgaagtataatcttgtactttgtggttcatcgcaaaatatgatgtatggactgtttcttgattctacggcacctctctatggccgtgctgatgagattatgagacttatgcctatacgcttgccgtatattcaggaggctttgaaccttgacgctgtgggtgccgttgaagagtatgctgtatggggcggtgtgcctcgttactgggaactgcgagaaaacagaagttcactttccgatgcgttgtggcacaatatcctttctgtaaatggcactctttacgaggagccgataaaactgtttcaagatgatgtgaaggacattgtcaagacttctacaatcatgtcctatatcggatccggtgcaaatcgtctttctgagattgctgccagatgtaatgagcctgcaactaatctgtcacgtccattgaagaaacttattgacctcggatttttagagaaagatgttccgttcggaattgacgaaaagaatgcaaaaaagagcctatataagattgcagacccttttatggcattctactatcagtttgtcgtgcctaaccgttcgttcatcgagcttggtcgtcgtttaccattagaacaggcattggcagcccatttctcggagtatgtgagtatgcattgggaaaaactatgcagggatgctgtaacgggaaatatggtcaatggaattgtttacggtaaggcaaaacgctggtggggttctgttctcaatgaggataagaagcctgaacaagtggaatttgatgtaatggctgaatctcttgataaaaaatatctgctggttggagaatgtaaatggacaaatcaagagaatggtaaacagttaacaactgaacttcttcgcaaggctaatttattgccgtttgccaagaactataccattgttccgatgttgctccttaagaatgctccgaaagatgatgcagggaatgcgatgttgccggaagatgttgttgagttgatgaaatgaattgattaaattaaagaactatgagtggcggatattttgataggagcacatatgcaatgcgcgagatagcggatactattgagcgtgatatagcaagagccttacagccaaagccagaaaaggtttatgaaaactattggactatttacgagaaagatagctttggctcataccatagctataaggactacatgagttttgccagttataaagatgcggaatcttttcttctaagagatacaactatcgttaaggcagaacaaaaatatgtagaccgacaattctttggtgatggggtgatattccaatcaacaacgcgatatatgtctgacacttctgacggcgaacagattccggtattatactcaatccatcattgttattatgaccgctatccgtatgacgctgatgtcttgaatctgtctgacgagacgataaatgttatgaaggaagcctatcggcaaatgcgtatagcagaaatatatgcaactcgcgtagatcggatgatgagtggtgatgacggagaagagggtctgcaagagagacttagtgcggatttggaggcctttgggaaagagtttcagacgaaagattggacttgttcatacgaggatgatgaagattgaatgaataccacaatgatgtataatgccacaaaaaatattcaattttgtggcaaaaattacttcagtgccctagtaaagaaaacgaacgagcgcattgatacccagaataaaaataacaggccgtttcagaggcctgctatctccataaagagcaatgcttaatgcctggtgtccttgggtggacataggtcatttccatagctgttgggattttggtagtgtaaacaagacttgacacagttcagtttacactaccttgaaattctaatgctgataaactgagaacttctctgattaaatttcatcatcgatagtttcgttaatgttgtccaaatatttctgcatatcgattgctggcactgtacctattgattgttgcaaataacttgtaagctgcatcagaaacataatcagggaatgatttggattgctgaatttgatagaattaaattctctgttattgtagtatttttgaaaatcctcgaaattcgcagtcttaatttcagtttctccctctttgttgttatagtcaacaaagaaactaccgttttcaatggtacaccccatttctaatgtataaaatccagaaagttctttaatatgcttttcgacggtatcttctttttgtgaacaattggtgccgagaatacctccgataattttagttaacggtcgaggggcatacttttgacctgaattaatcatatgagtactagttctcataagtcgtctaacacttgcgactttttctccagcatatacaatattgtgcttaccggcggatgttcctccaatatcaggcttcacctcaaatacagcatatacaccctcggcaggtatatacttaaatccattctgattgaaaataaagggagtataccaattatcatatatgacaatatcaatctgctggctcacattacctttatgatcaataaccattgctttatcaacactgtaccgatttggtaggtaatttctcagcaaatctatccatgcattttcaagggaatcaccttcactgccggggtgtgttatgaacttcgaattggtagccaatatcccctgcatctgggattgtaggctggtaaataactctttaatatcaattttattctctttcatattctatgattttaccattgttataataataagcgctcatctggttaatcttcttttttgataagctcacaatcatcataattggattattgataaggaccgtctcactccgagctatattagtaagagcttttttgtctgttacactatacattgaacttccattgggatgggaatgccattcgcctaaatagactaaaccttccttatatagttcatcccaaacactttccattccttctgtttctctctgaaaacaagtcggtcctgatatgattttaacaggagttagaacaagagaaacaattgcggtgttgttgtcagccgaatatttaccaacgaggaatcctccagtctcattcggaagagcttcaaacgcctgtttttggatttcttgcactatcttattgtctatttcaagactgagattatgtatattgtctttgtaaatcaatattttaatatttttaaaccattgtcagtatccctaagaataaaattttgcttcatttccgttccattcagcatgttatagatatgtcgtattgcgtattgtatcatcagtgcaatgtcattatatgacgctttgaatgtcgggctccagcatcccgtaggctcatacatatctaagtcatcattatgcagcatattattgaatacaatgttaacaaaatgctcaatattgggagaaaatgcacaaactagctccgaggcatgattggtaattgagatatttataatttcgggcttcaggttcaattcttccaatatgtgcatcaagtcatcatccgtggaacaatcgaaaataaggtcataactatctaattcatttatcgtatattctttatattgtttattgaatttagatgattttatagcaaaatcatactgattaggtaggcacttaatttctacataagggcttatcgcagataattctgctgaaagttccgttactttatctgtaactcctgttaaaaaagtatattcggaacggcaaatgttctcaggcttctttaagtcgtaatcgagcaaagaaatattggtacaaccacattttaccaatgttttagcaaacatacttccaatagctcccactcctattaccaatattttctttttggtaaatgtctcacagaatgctcctcttccgaaaaataaattgtatgaagcatcatatgtcattgcccattggattctatcttgataaaatttggttaaccatcttccggtctttattccattcttggtttccggtatgccttccgttgggaaattgcctaccttggagagcgatgctatccaatgcaactccccacttggtattttatacccgagcaatatcggaactggatatccaccaagtttcttgttaaatctattctcgtatgagtgcaaaaatttcaattgctcagaggtaaaataatcattaagatctttgaaatcatccaaagcaaatttgttgtatttacaaggaatcttacttaaaaccacatatgggcaaagaatgtactttaattcatcatatttagaactccataaacacttaattctattattcccatttgtgtctccaattgattgtacaacaaaattcttaactacttttccattgtaatcgccgtccattattggagcaaggaatgcatatccatatttatctgcttccacctttttctcgaattgagtaaattgtatggcaaagtaacaatcatctacagttgacggctctacaacaatgtgttcataatgaacatccgtttctttatttacatagtattttactacccaatctctcaactgtaaaaaatcagacttcaacctttgaatcgggtctacccaatatgatgtatgaagacaaagtgaaccgccagccataatatgagggtattccattagtgagttgttacggaactgaataggttcaataccttgtaccttatatggatagtaacttgatatggatgtttgaaacacaagtgctgacggcataccttctacaagtatacccacagcacctattattgtactaccgtcgtcaaccttgaatggggtttctatgtgtataaaggaaagtccctccaatacattgtttatatcttcaatcctcatttactctccgaatctttgacttgttggcggatatgaaggcccagatgatcctgatttgtatccgtatctgttttcctgtttttgatattttgcattaatcgggaaataaatggcaacgctatttgaatcattatcaatcgcattgatgatagttcgcattgttgttgacaacatactgcgtttattcatgtcaatagaagaaagcacattgttattagaattgcccgggtcaattagacgaaaactttcatccgtaacattatcagcaatatatgtcattacatatttaagcttatcccataaattattgtcacccgagtatgatgccattgctttaattgtaaacaattccaacataaaagacttatagtcctgatgattggtgtttttccaaatcttaagcaatcgtatcactttacgttcttccgacttgccggaaatatgatcaatttgggcatggatatttgttttttgtcgagagccctttttatatccccaatggtcctcgttgaaatacaaattcagattttttgtattaggataatcatctttattgagctctcgtcccgggacaacatccaacttgacaataactccatttttgtcaatagggaatgtgagaccaatagaaactttctgctttctgatataagttccatctttatattcattaaccaaaaagtcatatacatcattatatatagcttcgagagtgtcaaaactttcgtatttaaaaggagctaccagatcaatatcaaatttaatatttatagcggtatttttggcaaatgatccggagcgaaagacataatacaaattacacccataatgagtctccaatttgctttttacttcatccgcttttgcttgaaaggcatcaacttccttttgaatatgtttcattttatgagtctcaatcgactcggataaatactgatttatatctgtcgccatattattagttttaatacaattataacaaaacaaattatataccacctgtcatagtatgacaatttggcatatcaataataagcagtatataaattggagcatttctcaaataaattgtaaacttccttttttagagtaacttagaataaaaagttgttttacccttttaatctgtgtggaaacaaataatttgtttgtccgtccattcctcctattgcctcaggacgtttcagattgtatagtttgttttgctaaaattcatttccgataagtcaatatgttgaacatcagcataaataaatttcttcaacgaggaagatggtaggtggaagaaattaaaaatattaactattaaggatggagatgaaaaatttcaatccgtatcaaaaggaaattacggatttgaactagataggcgatgccctaataaaaagatgttatacgtaaagcaataaaacattatagttctgttgtacaataggtgattcttaagttttggctatcaaacaacaacctgaaagttgtgttatctcaattatttatagtacctttgcctataaaataaggcaaaggtatttttgattcatacaatggctgaaggaaagatagacaacgctttagaagaagtaaagaatataatggaaaacaaaagagaggattgggtttgccattcacaggctatagctgcaactatgtcggaccggatggaggaacttggcatgacacaacgagtgctggctgagaaaatgaattgtacccagcagtatgtttctaaagtgttgaaaggtcgagaaaatttgtcgttggaaaccttatgcaaaatagaaaatgcattaggtatcaagatattgcaagctagaataaataagtaataacaccacagcaggacaagaatatgtcaacacaaagcgaagcggcattggaagccggactgatagctacactccgacaaatggactacgagtatgtccagattgtcgaggaagataatctttataccaatttcaagcggcagttggagattcacaaccgcaaacgattggaagagcacggacgtactgagtttacggcagaagagtttgagaagattctcatataccttgaaggtggtactcgctttgaaaaggcaaagaaactccgtgacttatatccgcttgatacggctgatggacagcgtatatgggtggaatttctaaataggcagcagtggtgtcagaatgaatttcaggtttccaaccagattacggtggaaggacgtaaaaaatgccgctatgatgtgacgattctaatcaatggtttgccacttgtgcagattgaattgaaacgtcgtggcgtggaacttaaacaggcatacaaccaaatacagcgttatcacaagacttcgtttcacggattgtttgattatatccaactgtttgtcatatccaacggtgttaatactcgctattttgccaataatccaaatagtgggtataagttcacattcaactggacagatgctgccaatcatccgttcaatgaattggataagtttgccgtattcttcttggaaaaatgtacgcttggcaaaatcataggaaagtatattgtgctgcatgagggcgacaagtgcttgatggtacttcgtccttaccagttctatgcagtggagaagattctggatcgtgtgcagaactccaacgataacggctatatctggcatactacaggtgcaggaaagacattgacttcgttcaaggccgcacaacttgtgtcagaattggacgatgtggataaggttatgtttgttgttgatcgacacgaccttgatacccagactcaatcggaatacgaagcgtttgaaccaggggctgtagatagtactgataatacggatgaattagtgaaacggcttcaaagcaattccaaaattatcataaccaccattcaaaaacttaatgcggcagttagtaagacgtggtatagcagcaagattgatgctatccgtcattcacgtatcgttatgatatttgatgagtgccatcgcagtcattttggggatagtcataagaagataatgaagttttttggcaatgcccaaatattcggttttactggaacacctatcttcaccgagaatgcggtggatggacataccactaaggaaatattcggaaactgtcttcataaatatcttattaaagatgcaatagcggatgaaaatgtgcttggcttccttgtggagtattatcacggcaacgaaatagttgataacgataaccaagctcgtatggaggagattgccaaatttatccttaacaattttaacaaatctacattcgatggagagtttgatgctttgtttgcggtgcaatccgtgccgatgcttatacgctattacaagatattcagatcgttgaatccgaaaatccgtattggtgctgtgtttacttatgctgctaacaatagtcaggatgatgaacagaccggcatgggtacagggcagtatgcaaaagagagcgtgggtgaggcggatgaactgcaagccatcatggacgattataatgaaaacttcggcacatcttttaccacggagaacttccgtgcttactatgatgacatcaatctgcgcatgaaaaagaagaaggcggatatgaaaccgcttgatctttgtcttgttgtgggtatgttccttacaggctttgacagtaaaaagctgaatacgctctatgtggacaagaatatggaatatcatggtttgctgcaagcgttcagtcgaaccaaccgagtgttgaacgagaagaaacgttttggtaaaatagtttgtttcagagatttgaaaaacaatgttgatacgtctattaaattgttcagcaactctgataatcctgaagatatagtacgccctccgtttgaaaaagtaaagcaggagtataagagtttggcaactgattttctgcaaaaatatccaacaccaagtagtatagactttctgcaaagcgaaaatgacaagaagaattttgtgcttgcattccgtgatattatccgtaaacatgcagaaatacagatatacgaagattacagcgaggatgctgaagacctcggcatgactgaacaacagtttaacgattataagagtaaatatcttgatattacagtcgggtttattgacccacctgctgcaccgtcaactgttgcggaagatcctgttccatacggaaataaccaaggattggaagatattgatttctgtcttgagctcttacacagtgacattatcaatgtggcttacattcttgcactaattaatgaccttgacccttatagtgatgattattctgaaaaacgccagaatatcattgatacaatgattaaggatgccggaatgcgtggcaaagccaaactcattgacggttttatcaaaaagaatgttgatgaagacaaggagaatttcatgaacggtcgtaataaggctgacggaacaaacgaattggaagaacgattaaaccaatatattgtgtcagaacgcactaaggccgtaaatgatttggctgatgaagaacagatttcagcggaggtgcttaatcattacatgaaggagtatgactatttacaaaaagagcagccggagattatacaaaaggcattgaaagagaaacatcttggtcttatcaaaacccgaaaggctttgacgagaataatggaaagactgcgtagtattataaaaacgtttaattgggaataaggatgtcaacatacaagataaataatgagcaactaacgcttataaaagagatgccatttaagttggagaaggaaattcaaaacatcgttgaaaggaatctccagacgttgcttgggcttgatttcatcaagacggaattttctattggttctttccgtatagactctttggcttttgattcagagaaaaaatcctttgtaataatagaatataaaagagataagaattttagtgtaatagaccaaggttatgcttatctatccctgatgttaaataacaaggctgaatttattttagagtacaacgagtctaagtcgggtgcactcaaacgaaacgatgtggattggtctcagtcaaaggtgttgtttgtttcacctaattttacaacttatcaaaaagaagctatcaatttcaaagacttgcctatagaactatgggaaatcaaacgttttacaaatgatacgctttcatttgaacagatagtaaaccgttcaagcaaggaaagtattaaaacggtttctaatagtgaggcaataacaacggtaagtaaagaaattaaagtttatagcgaacaggatcatttagagaacataaaagatgattttctcaacatctatacagaaatcaaagagtttttgctatcatttggagaggatattacaatatatcccaaaaagaaaactataggtttcaaaataggaggaaaggtattttgtgatatagttatgcaaaacaagggaataaggctgtttctcaatgctaagaaaggaacactcaaagacccagaaggtattactcgtgatgtgtcagaagttggacattggggaaatggggcttatgaagttcgggcacttatatacaaagtaacacttgattctttttcataacttttggttataattccaaaactaaatgtcgttctttgagcacagttcagaggagtaagagatagagcttttttcttatatagacttgctaaattatatgcttaaatataaaatccctcagattgttacgttgaccctgaatatcggacattgagttaatgtaaaaaaataaggagctaagttttagacttaactcctcaatgctcaacagtcgggatgacaagattcgaacttgcgaccacacgccccccagacgcgtactctaccgggctgagctacatcccgaattgcgggtgcaaatgtacggctttattttaaaatagcaaatatttatagtgctttttttattgaatgaacttataatttgcagtttcaaggctttcggccaacgtgccctgctctctttttacttgtatgcctgcttcgcaaggcaatggctttgagcgggcaggcatactttgaatgaagttattgcaggtttaggctgtttcttacggaagtgatagccggactttcgggcgttacggatttccgggtacaataatcgaattccgcagatttttcgccgctaaatgatttccacttcagtttcaatttaacggtcttgccttctgtatcaggcagggcatccaacttgaaagcaaccagtccgtccgcatacctgccgtaaatgtcgcccttggcattgtggcggaattctacttcatacgggttttccggattctcgctcagcagcagattgacaaagtgctttgtttgatagtctccttgctgagttctaaagcgaagggtcagataaccgtcttctgcgatggttacccaatcgttcactatttccaccgggtcggtgccgtatacggtatcgttctcttcacccaaatccggggcgatgggtttggtaaggatactgtctatccagtttatatgtacagcttgggtgtagatatcgctgggctcgtccacttccttgtagtttactaaagcgcggacttccttctcgccgtagggagatttcgtcatgttggtaggcagcagagtggtcttgtcatccaattgcagaaagactgtctggtctgcatcggtctttaccgttaccagggcattggggaatctcatggcataattatcatcgtcgtccaggcacgattggaggcttaaggagctgatggttgcaatagcgattaaaattttcttgttaaagattgacttcattttcatagtgtactcttttaaattaaacatttggaataggtcttacttttatagaaatagcatatttgcgaaaaccctgcatgcagcattgttaattaatgataagagccggagtaagctggtgcggaatattattccccgatacatgaaagatatttgtatatcaggtggaatatgattacctttgctgtatgagatgcacatctcgcgtgtgttgagatgtatgtctcgaactgcatgagatgtgcatctcgtgcatgttggggaatagctgtccggccgtatggaaactggctttctgtttaggggaagtaaccttcgggtggggtgtcagcagtctggttgcagtaagaaacattatgttcattgtgaaaagagtatgagtatagtctatttggttcgaaagaaggttttccgcacggcagaaggggtgaagcaactctattatgctgtgcagcgtgtgttacagcggcgtggaggtgtgacggcagagctgctggcgcagcgtatggcatccagaaaagggatgagttcgggagacgtgcagagtgtattgatagatttgccgaagtttatagaggaagcgctgatggagggagagtcggtgaccattaagaggctgggttccttccatgtggcggtgacgagtgacgggtttgagcatcccgacgatgtgatgccgggcaaggtacgcttatcccgtgtctattttcgtccggataagtcgctggtggcgaggctgaacagcgggatggatttctaccgttatccgcttagccgatatttccctcacgatatgttgcgaccggaaacgctgcgaaaggagcgggccgagggaaagacgggaattccggatgaagacccagttgggatggaaaatgatacggaggacttttcgggggaggagtgagcgatgaatgtggaagaattcagagaatactgtctctccttgccgggagtgctatgctcccatgcactccctataaaagtcgaacatttcgaagatagtctccttgtctgccgtctggttgagacagatgtcacccacttctttcaatagggtgaagttgatgactccggcggtattcttcttgtcatgcttcatcagttcgtacagctggtcgtactgtttgcagttgaaggtgaagctgccataattctctttgacgaattggatggtctggcgcatcttgtccttcgggaatccggtctttatataagaaaggtagagttcgcagaccagcccccatgccactgcatagccgtgcagcaccggacgcctttcggcaagggcgaggctttcgaaggcgtgtcctacggtgtgccccaggttcaaggctttgcggatgccatgttccagtgggtcctcttctacgatgcgttcctttacctgcacggaacgtcctaccatggacttcagcaaggcataatctatcttctccgtatcgaaggccagcagttccgccagatgttccggggtactgatgaggccgtgcttcagcatctccgcatagccggagaagaagttatgggcatcgaggctgcgcaggaactcggtttccagcagcacgcaggcggcaggagcaaagacgccgatttcattcttcagaccgttgaagttgatgcccgtcttgcctcccacggaagcgtcgaccatggcgagcagcgtagtgggaacgttgatgtaggcgatgccccgcttgaaggtggaagcggcaaaaccgccaaggtcggtcaccatgccaccgcccagattgatgagcagggagtggcggctggcccctttctcactcagggcttgccatacggcagccagcgtttccatattcttgtgcacatcttctgccccgataataatctcttccgcttcttccagggcggggataccgtccagatgcgggcggcagaggcggtgggtatgctcgtcggtaaggatgaaaagcttgtcatggggacacttcgctatggcatgcgtcaggctgtttgccagtccttcgcaaaggattacttcttgtttactcatcttgttaattacaaattacgaattaccaattactgatgttacggattatgaaggaaagggagccttcttcattatattgtggcacaaagatagctcttttggcaataaaacgttatctttgtcccgcgaaattctatgggtggcaaggtgtttccgtcatctgcctcccgctatttgtaattagtaatttgtaattgattgatagaaatgagagcattacttcccgtttattgccgtccgttgggttatttcatcatagctctggcgttgttccttcctttcatattcctattgtggggaaaagtgacagatgccaacttgctgttttacaaggaatgctccaaactcctgatgatgatgggggcactgatgataatctttgccttgacgaagaacgagaataaggagatagagcaggtgcgcaacaagtccacgcgcaatgccatctttctgaccgttctttttatcttcggcggtatgctctaccgggtggcgcagggtgacctcctttcggtcgattcttcttcttttctcatatttcttatattgaatgtgctttgcttggaatttggtataaagaaagcgacagttgatagattatttaagcggaatagtcgataaataaagcaaatcgtcatgtggggcattaaaccttttgcccggaagtctgtcaaatgaaacagtgaataaaaggcattgttcatttagaatagacaaagaatagacacatgaagaaaattatcacggggatggcgttgctgttggtaacaacgctgtctgcattttcacagaccaaaaacattacggtatcgggccgtgtcgtggaggacaccaaggagcctgcgatacaagctaccgtgcagttgcttttgttgccagacagtgttcaggcatcgggtacggccactacggcacaaggttatttcactcttcccaaagtcagtgcgggtaaatacgtgctgaaggtttcctacatcggattcaagagccagtacatccctttacacctttatgctacgacaactgccaagaacgtgggtacactgacattggaaacggatgcggtgatgctggccgaggctgtggttacggcagaagcgccgcaagtgcaggtggtggaagatacactggtatatacttcatctgcctatcgtacccccgagggagccatgctcgaggagttggtgaagaagctgcccggtgcggagattgacgacgagggtaatgtgaaaatcaacggtaaggacttgtcgaagattatggtcgacggcaaggagttcttcggtggagacgtaaagaccggtttgaagaacctgccggtagatatgatagagaagctgaaaacctacgataagaagtccgatttggcacgtatcaccggtattgacgacggtgaggaggagacggtgctcgacctgaccgtaaagaaaggcatgaaccagggttggttcggtaatgccgacgtggccggagggacggaagaccgctatatgggccgctttatgctgaaccgcttcgtggacaaaacccaggtgtcggtagtgggttctgccaataacgtgaacgaccagggcttttcgggtggtggcggtcctccgcgctggcgcaggaacaacggacttactgcaacgaaaatgctgggtgtgaacttcgctacccaaaccgataagctggaactgggcggtagtgcacgctacaactatcaggatggggatattgcaagtatcggttctaccgaggactttctgccggacggcaactcttactccaactcgaacagcaggcaacgtaacaaagccaagaatttcaatgccgatttccgtatggagtggaagccggactcgatgacgaatatcattttccgtcccaacttctcgtacggcaaaacggacaatctctccaattctgagagcggtacgttcaattccgacccttacagtctggtgagcgaccccaataactggctgaatctggagaagattcttaatccggacgatgacccgttgaggagtatccgtataaatgctatcaacagcggttcgctgaacgacaacaagagtgtgtctacggatgcaaccttgcagttgaacagaaagctgaatgacaaaggacgcaatgtcacgttccgtggaagattcggttataccaataatgacaacaaccagtatacggagtcggaaacacattacttccagttactgaatgctttgggaggagactccatcttggttcgtaaccagtacatcactactcctaccaagaactacaattacagtgcacagctgacttacagcgaaccgatagcccgcgccactttcttgcaattcagctatcagttccagtacaagtatagcgagagcgacaagacgacgtatgatttgcagggttttccggattggggattgtcaacccagcttcccacgggatatgaagagcatgcggtggatagtctgggtaagtatgcggaataccgctactacaaccacgatgcatccgtgtctttgcgctttatccgcgagaagtatcagttgagcgcaggtatgtcgttccagccgcagcattctgtattgtcctataagcgcggcgactatatgattgataccacccgcaatgtgttcaacttcgctccgaacctggacttgcgcatccgtttctccaaggtgagccagctgcgtatgacatatcgcgggcgtagcagccaaccgagtatggagaatctgttgccgattgtggacaactccaatccgcagaatgtacgtatcggtaatccgggcttgaagccttccttcacgcacaacatgcgattcttctataatacgtataatgccgaaaagcagcgcggtattatgtcacacgtcaacttctcggcaacgcagaatagcatcagcaatagccgtgtgtacaattcggagactggtggatggactacaactccgaagaatatcaacggtaattggaatgcgttcggcatgtttggcttcaatacggcactgcccaataagaagtataccatcaactccttctccaatgccaactatcagaacaatgtggcttatctgacgtccggtaagggagcagatgccgtggaacggaagaatacaaccaccaacctgacgctgggcgaacgtctgaatgccgcctatcgtaatgactggtttgaattcggcttgaacggaagcatctcctattcaatagagaaggataaactgacgcctgacaataatcaggagccctataccttctcctacggtgccaatacgcagatttccatgccgtggaacatgacgctctctaccaacattgccaaccagagccgtcgaggatatacggacagcagtatgaaccgtaacgagcttatctggaatgcacagttgtcgcagactttcctgaaagggaatgccaccgtcagcttcgagatgtacgacattctgaagaagcagagtaacatcagccgttcgctgactgcaagcggccgctcggtgtacgaatataacggcgtgaacagctattgcatgcttcacttcatctatcgtctgaatattttcggcagcaaggctgcccgcgataagatgcagggcagacgcggcttcggcggtccgggcttcggtccggggcatggtcctggcggtttcggaggacgcaggccgttctaaagcggaggggatcacccccctaatcagcttgtcattctgatacactctcaattctgtggcaggtttctttttgattatttttcagacgcggatgacgcagataagaatattaaaaatctgcgtcatctgcgtcatccgcgtcaaagcgatagcaagtataagttttcagacaagttgggggaagagggacttttatgttaatctctgtaatcttcggtgaaagtttctgtgtttttcctacatttgtttcacacttaattgtctgtgaacatgcttgattggaacttcattgccagccagattgctacgatagccttcgacattgtttatttcggtgccatcatcggaacgattgtcgtcattatcctcgacaaccgcaatccggtgaaaaccatggcatggatactgatactgatgttccttcccatcgtggggctggtgttttacttcttcttcgggcgtagtcagcgccgtgtgcgcatgatagggaagaagagttacagccgcttgttgaagaaacctatggcggaatatctggcgcaggactcatgtgcgcttcccatcaattacagtcgtctcatatccttgttccgtaataccaaccaggctttccccttcgatggaaaccgggtggaagcctataccctggggctctccatgctgcaatccctgctacgcgaactggggaaagcaacgaagcatatccacatggaattctatatctttgaggacgatgccattgggcgcttggtgcgtgatgtcctgatggaaaaggcgcgtgccggggtagaggtacgtgtgatttatgatgatgtgggttgctggcatgttcccaaccgtttttttgaagagatgcgcgaggccggtatcgaggtacgcagctttctgaaggtacgttttccgcttttcaccagtaaggtgaactatcgtaatcatcggaaaatagttgtcattgacgggcgcatcggctttgtggggggtatgaatcttgccgaacgctatatgcgcggattctcatggggcatctggcgggacacacatctgctgctggaaggcaaggctgttcacggattacagaccgccttcctactcgattggtactttgtggaccgtacactgattacgtctacccgctatttcccgaaaatagaaaactgcggtacttccttggcgcagattgtaacgagtgagcccgtaggcccatggaaagacattatgcagggacttgtcatatccatttccagcgcaaagaaatatttctatatccagactccctacttcctgcccaccgaagccgtacttgttgctatgcagacagccgccttgtcaggtgtcgatgtgcgtctgatgttgcccatgcgtgctgataaccgcttgacgcatctgggttcctgctcttatctggcagatgtgctctattcgggagtcaaggtctatttctataagaaaggcttcttgcactccaaactgatggtttcggatgatgagttgtccacggtaggctctacgaatgtggatttccgcagttttgaacataactttgaggtgaatgccttcatctatgacacagaaacagcgcttcagatgcgcgaaatcttccttcaagaccagcgcgactgcgtacaagtattcctgaagaactgggtgaagcgcccctggtatcgtaaggctgcagagagtgtggtgcggctgatggcgccgctgttataatgaagaatgatgaatgaagaatttcttgaagtgcattcatatcgtaccattcttcattcatcatttaaatatcgtgaagttcacgctcccgtatacccttctctccacaaagtgcggatgttcctcgaaactgtttttcttcccgtgttccaagacgaagagtccgtcttctttcagcaagttgttctcgaagatgagatcgggcaaggtttccagcccggcaagctcgtagggagggtcggcgaagataaaatcgaaccgctcgcgtccgctcttgaggtatttgaatacgtcaccgcgtatgggcaggcacttgtccgtctttaattcctgcataattttgcagatgaaggcatagtggtcgcggtctttttccacgctgattacttggtcgcagcctctggacacaagctcgatgctgatgctgcccgtaccggcaaataggtcgagggcacggatgccgtcctcaaagtccatgtagttggagagcacattgaacagattctctttggcaaagtctgtggtggggcgtgccttgaaggagtggggcacgtcgaaacgtcttcttttgtatattccgctgattactcgcatagggttatggcttgcaggtcaagattagtggcgggattcatgatgaatacctgccggatgaattttcgcagttcgggcagtagcagttctttgtcgtttaggtcaccggtcaggtgcagctcatcgcgctcctgctcgaagccgagttgtttccatatatataataggtagtagacacggtcgggtgtgcttctgcattcaaaggaattggcaagaaggaggcgtccgcgctcgtagccgtatacgtctacggcatcttttcgcaagtgtgcatacatcttccggttgttgcccaagcggctctttgaggagaagaactcaatgaaggggctggcttgggaatagaacttgacatcgggatactgttcgcgaaggaaggagcagacactcttatccatgccgaacagtacgacagtgctgttcttatgcagtatgttgtattgtacggtttcgttttcccgtttaggatggttgtgatagaaaatgatttccgtttgttcgtcctcgaagaactccaggggaatgaacgtgaagcgtttgtctgccatgagcacattgacacggcggaaggggcgttccagccatgccagttcgcggaaggtctgtttcagattggcagtgagggagaaggactcgtccactgcacggtcgtagtaagagaactcgccgtcgcccaaagggttgaacacagaaaaagaaaatccatccgtactgagacggatggataatgtatactgttccgatttattaaaatcagtcgtttctatcatacgtttgtcggggtgagattattcccagttaccggcgttgttgttagctgtttccaagctaccaatcatcagaccgcagtacttgccaagtttggtttgtacgtccttgatgttggcaatttcttgtgcatccagaccgttcaaataaacttcgtacggagtcttcacttcgagcagacagaaaggagcaccggatttagctgtatcgttcttgatggccatttcgaactgtgcaccgtttccgaagggaacatatctcattgaatcggggttgaagcccttcgggaagatagtgtccaatacggctacccacaaggtgtcacgtttgaagttttccaatccccatttcttgacgtcagcatagttacctgtcttctttgccttattgatgatgttgatggctttcttttcagtcagaccgtcttccagctgcttatcgttcagttctccttgcttgaagatgaacggaagtttctggtttttaacaaagtcaatcagagagtcgaagcttgcagtatattgctggtcatgtaaagtacgatattccaattgtgctttacggatgtcaatcagacgtgcaatgacggctgcgtctctgtgcttctttgctttttcaaagttgataggacccataatgctggcataacaaatataaattagcaccaaagcacataagcctaaaatgacattaaatactgttttcatgataaatatgttttttagttgttatattcgcaccgcaaaaataaaagaaattaatttaaaaacgatagttccctttacttttttctgttacaaaaatgataaataactatttagaaaggcaaattaaggaaaattttccttaccaaccaactcctgaacaagaaattgctctaaaatctttatcggagttcctgctgtcgccccgtagcgaggtggtttttatgcttcgtggttatgcggggacgggtaaaacatcgttggtcggtgccttggtgcggacgctggacaagttgcaacagaagtcggtattgctggcaccgaccggacgggcggcaaaggttttctcggcgtatgcggggcatccggcgtttacgattcataaaaaaatctatagacagcaatctttctccaacgagctgagcaatttttctgtgaacgataatttgacaactcacactctctatatagtggatgaggcatcgatgatttccaatgagggactgtccggttcgatgttcggcacgggcaggctgctggacgacctggtgcagtttgtctattccggccagggatgccgcttgttgctgatgggcgatacggcgcagttgccgccggtgggggaggagcagagtcctgccctttttgccgatgccttgagaggctacgggctggaagtggtggaggtggacttgacgcaggtggtgcgtcaggagcaacagtcgggcattttgtggaatgccacccgcctgaggcagttgatagcggaagacgattgctacagcctgccgaagataaaggtttcggggtttgccgacattaaagttctgcctggaaatgagctgatagaaacgctgaactcttgctacgaccatgacgggttggatgaaactatcgtggtgtgccgctccaacaagagggcgaacatctacaacaaaggcatccgtgcgcagattctctggcgtgaggatgaattaaacaccggtgatttgttgatggtggcgaaaaataactacttctggacggaaaaggagaaggagatggatttcattgccaacggtgagactgccgtggtgcgccgcgtgcgccgtacgcgagagctgtatggcttccgctttgcagacgtgacgctggtctttcccgactataacgactttgaactggaagtgaacatgctgctcgatacgctgcataccgactcgcctgcgctgcccaaggcagaaaacgaccggcttttctactccgtcctcgaagattatgccgacatcaccgtgaagcgcgagcggatgaagaagatgaaggcagacccgtactacaacgccttgcaagtgaagtatgcctatgccgtgacttgccacaaggcgcagggcgggcaatggaagaatgtctttctggaccaggggtatatgacggatgaatacctgacacccgattatttccgttggctctacaccgcctttacccgtgccacgggaacgctctacttggtgaactatccggaagaacaaatagtttgaaaaagagaggggtaccgatgcagtattccggcattttttgtatttttgtagatagaacaactataactgaacaagtatgaagaaactatactctctctttgccttgatagcactgctgtttaccgcttccggttgcgaggacgattaccgaagcatggtacttttcgaaggtgtggagcctatctaccagattgggacatgtgacaatctggtgtccaatctttcttattatctttctgaaacaaacgaagatacagtgctgggcattgacggcggcgacggttcctataatgtgattaacgagcacgagtcggtggcttccgtgacttttaccgatgatgtcaacgggtatcagcgtatcaagattcatccgctggcagagggggagacgattgtgaaggtgatggatggttccggtgaggaaacacaactgcgcatcacggtgaaaggtcgtaggcaatatacgttgacgaaaatgggcttcgagtatggtatcagtagtggtgcaccgacggaactgctgggtgatgtttctaaggcacttgccgagcgtccttgggtgaaggatggcgggtattatgtgctggtgcccgaagatttctccaatagtatgtggaaaggtgtattggaaatctatccgacgggaaaagaggaggaaccgctaatggggatatacgagacagttccagtggaagatgagaacggagatacatatgcattgtggcagtttacttataatggagagaagaggctctttacgcggacggtctcgggaaatggtaaatgtgtacttgcggaaaatgtaactcctttctgtccttccggtttgctgcccgaaggtgcactggtggtttatcgcgaaatgtttatacttcggatggaataaggttttagtggaaatcttgtcaagagcagatttacgaaagattaacagacgggaggcttaggcttcccgtttttgtttctgttgcgcatcatctgtctgttctgtatgcatcattcgtttgcttcgaatgcattgtctgtttgttctggactaatcatccgttccctccacttcactgtcccaaaccttagggtttttcacggaaaccccagggctttggagggtaaatgccagccatttcacttgctaaggtgtggcatttaggatggtaaggtgtggagtttggggagccggcatgtggcatttcaaatggaataccgtggaggataaaaagaaaaggagaagcaatgctcctcctttcccggtagtttaattttgaaatatctaaaaaatgacattacaaatatacaacatcacagaggcgatgtcaagtgtttcgccaattattttcaattataatcctgccaattccaaaactttgtcaatggcagcgttcagtccgtcagcattcttaccgccggcagttgcaaagtggggctggccaccgccaccgccttggataagtttggcagcttctttcaccaggttaccggctttcagtccgcctgccacgaggttgtcgctcagcatgacggtcagcatcggcttgccttcggcttctgttcccgctacgaagaacaggttttccgtaatctggccacgcaactggaaggcgatgttcttcactgtttctgccggcaggggagcacagaacttgatgactttaacgccattgacttcctgcacgttcttcagcagtctttctttcagctgtgcttctttctctttcatgaagtcctctacctgcttcttcagtccggcgttttcgtcaatatacttacggatggttccggcaaggtcgggtgcgttgttgaagagcgccttcaagtcgtgcagcgtgtcctcgatggtgttcagcagttcctccacgcgtgcacccgtgtaggcttcgatacggcgcacaccggcagccacggagctttcggagataatcttcaccataccgatgtttccggttgcagccacgtgcgtaccaccacagaattctacggaagaaccgaactggataacgcgtacatggtcgccgtacttctcgccgaacagagcgatggcgcccagttctttggcttcttcgataggaatgttgcggtattccttcaaaggtatgttggcgcgaatctttgcattaacgatgtgttccaccttgcggatttcctcgtccgtcaccttctggaagtgtgagaagtcgaaacgcagggagtccggtgtaaccaaagagcccttctgctctacatgctcgcccaatacttcgcgcagcgcagcatccagcaagtgggtagcagagtggttggcggcacaagcggcacgcttgtcggtatccacgcatgccatcatcggagcttccatgtgttcgggcagcttcttggtgatgtggataggcaggttgttctccttcttggtgtctaccacttcgatggtctcaaactcgttcaccaatacaccggtgtcacctacctgaccgccgctttcggcatagaacggagtcttgtccagtacaatctgatacaaggtttggttcttctgcttcacttgtcggtagcgcagaatggatgtttcgtattccgtatagtcatatcctacgaattcggtagtaccctcctttagcgtaatccagtcaccggtctctatggcggcggcattgcgggcacgctgtttctgctgctgcatttcggcgtcaaactccttgatgtcggcagtcatgccgttttcgcggagaatcagttccgtcaagtcgagcgggaaaccgaaggtatcatataaggtaaaggcatcctttccgctgatttcgttcttgccggtggatttggcatctgccatggtcttttccagcaggcggatacccgtctccagggtgcggaggaaggaatcttcttcttccttgataactttggcaatcagttccttctgtgcatccagttcgggataagcggcgcccatgttctcgatgagtacggggaggagcttgtacatgaatgcctgcttctgtccgaggaacgtgtaaccgtagcgcacggcacggcggaggatacgacggatgacgtaacctgccttggcattgctcggaagctgtccgtcggtgatggagaaggcgatggtgcggatgtggtcggcaattacacgcatggcgatgtccgacttctcatcttcgccatacttcttgcctgccatgtctccgatggctttcagtatcggttggaatacgtcggtgtcgtagttggaggtctttccttgcagtgtgcgcaccagtcgctcgaagcccatgccggtgtcgataaccttggcgggaagtccttccaggctgccgtccgccttgcggttgaactgcatgaacacgaggttccagatttcaatcacctgcgggtggtctttgttcaccagctggctgccgggtactttggccttctcttcttccgaacgggagtccacatggatttccgaacacggaccgcacggtcccgtatcacccatttcccagaagttatcgtgtttgttgccattcagaatgtggtctttcggcaagaactgctcccagtaagaagcggcttcgttgtcgcgttccagtccttcttcggcgctaccttcgaatacggtggcgtagaggtctttggggtcgagtttcaatacatccaccagatactcccatgcccaggagatggcttccttcttgaagtagtcgccaaacgaccagttgcccagcatctcgaacatggtgtggtggtaggtatcgtgacccacttcctccaggtcgttgtgctttccgcttacgcgaaggcatttctgcgagtcagcaactcttttgtatttcgccgggtggttgcccaaaataatatctttaaactggttcattcccgcattggtgaacatcaacgtggggtcatccttaatcaccatcggggccgaaggcactatctggtgacctttactttcgaagaaactcttgaaagagtctctgatttcgtttgcagtcaacatactctctattgatttatctgattctaatttgatttaccttctcttgtcgttttttgcccgtttcttactactaactacttgctacttagtcttaatattcttgaaaaaactgtgcaaagatagcttgtttttattacttttgtcgcattgacaagcgaaatatttcctaagatgcgcaaagtttactacatttataatccccagacgcagacgtacgaccgtatttatcctaccgtgaggcagcgggcgctgagcattctccgccgtttgttcatcggtatggggctgggtgcgggcagtttcatcgtattgctgcttatcttcggctctccgtcggagaaggagttgcgaaaggagaacagcaaactgcaggcgcagtacaacgtcctctcccgccggctggacgaggctatgggagtgctgcaagacatacagcagcgtgatgacaatctgtaccgggtgattttcatggccgaccctattccttctgccatccgtcaggctggatacggcggtaccaaccgctatgagcatctgatggatatggctaactccgacttggttatcaataccacgcagaaaatggatatgattagcaagcaactctatatccagtcccgctcctttgacgatgtggtggagatgtgcaagaatcatgatgaaatgctgcgctgcattcctgccatacagccggtttccaataaagacctccgtaagaccgcttcgggttacggtacgcgtattgaccccatttatggtaccagcaagttccatgagggtatggacttttcggctccccagggcacggatgtctatgccacgggagatggcaccgtggtgcagatgggctggcaatcgggctatggcaacagaattgtgatagaccacggcttcggttatcagacggtgtatgcacacttgcgcgatttccggacgaagttgggcaagaaagtggtacgtggtgaggtcattggcggggtaggcagtacgggcaagagtactggtccgcacttgcactacgaagtacacgttaagggaaaagttgtgaatcccgtcaactactacttcatggatctcagtgccgaggattatgaccgcatgatacagattgcggcgaaccatggtaaggtgcttgattgacggatgatttatagagaaaggattacatcatgctgaatacagataagaatttaaagttatattactccatcagcgaggtggctgccatgttcgatgtcaacgaatcactgctccgtttctgggaaaaggagtttccgcaactcaatccgaagaagggggggcggggaatacgccagtaccgtaaggaggacattgagacagtgaaacttatctatcatctggtgaaggagcgcggaatgaccttgcccggcgcccgccaacggatgaaagacaataaagaagctacgatacgcaactttgaaatcgtagatcgcctgagagctatccgcgaagaactggtaggcatgaaactggcattggatgagtttacttacgaggatgtggagagcttgaaggaaaatattcaaggactgaagtagaataaataccactccgtttattcctctactctcgtcacttgttttatattctgtatctgcttcaggttattgcagatagtgcgcacgtcgtccacatcgtgtacatagagttgtatctttccttcgaagataccgtcgttggtttcgatggtcagtttacggatattcacgttgagctggcgggagatgacttgagttacttcgttcagcaatcccatgctgtctataccttttatatatatggtgacgaggaacgacaaatccttgtgagtgtcccactcggtggcgatgatacggtttccgtagctactcttaaggcgggtggcaacggggcattggcgcttgtggatgacaacacggttttgctcgtcgatgtatcccagtacgtcgtcacccggaatgggatggcaacagtcggccataatatagttctttgagatggtctcttccgtcagcttcagaatctgcttagtgttgattttctcttgcggtgttttctcttccggttgttctttggcatccttgttgtccttgttaccgaaggagaaggtcaggaacttcttccagttgctgttctgcttttccttgaacacgttcttgtcggcatcgcccagcacaacccgtttgttgccgatggcaacgagcagctcgtcgcgggtgtggaagccgtgcagcctggtcagcttgtccagagcagcattatccatacgtatatcctcgtttttgaagaattcgttcagtatggtttcaccttctttctgataggctttcgcctctttgcgcaggatggcggcaatcttggcgcgggcgcgggcggtggtggcatacacttcccactccggctgcacgcgttgcgatttggaggtcaatatctctacctggtcaccgctttgcagtttgtggcttaggggaaccagtttgtggtttaccttggcgccgatgcagtggctgccgatgtcggtatgcaaggagaaggcaaagtccagtgccgtagagttctgcggcatggtcttgaggtcgcctttcggggtgaagacgaaaatttccgatgcaaacaagttcagtttgatggtatcgagaaaatcgatggcgtccggttgtgggtcgtccagaatttccttgatggtacgcaaccatttctccagttcgccttcatcttcgctgcctccgccttctttgtatttccagtgggcggcaaagccttgttcggcaacgtcattcatgcgttcactgcggatttgtacttcaatccattgcccgttgttacccataagggtgacgtgcagggcttggtagccgttggctttgggatggctcacccagtcgcgcaggcggtcagggtggggcttgtatatcttggatatggagacgtaaatgtcgaagcagtcgtttagctcttcctctatattgcggggctcgaagatgatgcggacagcaagcaaatcatagatttcctcgaaggggacatgcttggtctgcattttgttccagatggagtagatggactttacacgggcaaggatacggtatttcagtcccattttgtccagttgcgcccgtatcggagcggtgaactcattgaataccttgtcgcgctccacggcggtggcttccagtttctcttctatctcgtggtactcttccggatgttcgtacttgaagctcaggttttccagttctgtcttgattttgtacaagccgaggcggttggcgagcggggcataaatatagagtgtttcgcctgcaatcttgaactgcttgttgggcagcatggagccgagtgtacgcatgttatgcagacggtcggctatcttgatgaggataacccggatatcgtcggacatggtgagcagcagcttcttgaagttctctgcctgcgccgaggcacggtcgccgaagataccgccggaaatctttgtcagcccgtctacaatctgggcgattttgggaccgaagatgttttcaatatcctctacggtgtagtcggtgtcctccaccacatcatgcagcaatgccgagcatatggaagtagaccccagtcctatctcattacagacaatctttgccacagcaatggggtgcatgatgtagggctcgccggaacgacgcttgatgcccttatgcgcctggttggcaaagttgaatgctttggttattatttcgacgcgcttgcggtgcttggtggccaaatagtcgttcaacagttcttggaatgcctgttcgatcatttcctcttcggctttttccttttccttctgacttatattttcttccatatactgctttctcctttcttcacttcactttttgcaaaaataagcaattttcaacaccgggcaagcgtttatgtctttatttataaatcttcaagcgctttcctgcggagattctggtactgcgcaatccattccaactttttaactgattgacagtgacaccgtatttccgtgcaatgctgccgagattctcgccactgcgtatcttgtggtaggtgacattccccgtagcggtactgcctttgctgctacgtgccgtcgagcgtgtattggaaacggccacgactctgcggttcttgaacagctcgttactgcggtgggcatagatggtgtcttgcttgtcaatgaaggcactgatgtagttgatggggaggcgtagcgtctgcggcttgctctctccggggatgatgcttttcttgaattggggattcaggctctttatctggtccaggctgatgccgcataggtcggaaatctgctcgaaatgaaggttacggcttacttgcaccgtatcggttgcttccggaatgtcggtttccatggggcagatgttgtgcttgcagtagtaggtcattacgtagttggcggcaatgaaggcgggcacgtagccgcgtgtctctttgggcagatagttgtagatttcccaataatcggttttccctcccgagcggcggatggctttgttgatggtgcccggaccgcagttgtaggcggcaatcaccaggttccagtctttgtaaatgtcatacatgtccttcaggtagcgtgctgccgcccaggtcgcctttatcgggtcacggcgttcgtctacgaggctgttgctttccagtccgtatatctttccggtggcgagcataaactgccatagtccgcaggctcccgcgcgggatacggcagaagggttgagagcagattctatgatgggcaggtatttcagctcgagcggcaggccgtaggcatccagcgcttcttcgaagatgggcatatagaagttgcaggcgctcagcatgaaggcaacctggttgcgcagacgtccggcatacatgtcgatgaacttgcgcacaatctcgttgtatggcatttccatgacggtcggcatgcgcgacaaccggtctatgtatacagagtcactgaacatcgggtttacggtagaggtgctgcagtcttttcccaagtctatgtaattcttggctttccagtcattgagcaggctgtccagcggataggtcatgcttttgggcagctcgatggattcctggcgttccgtgccgttttcgcggataagcacttccacgctttcttgcgcatgcatggccggagcggtgaagagggcgcaaaacagaagcgaggaaccgagaataattcttttcatatatatggccttgtgtgtcattaggtaataatttatgctttaattttcgtttttagaatcggaaactgcattgcacgccgacgttcttattagaggaaccagtcatctggctgttgattatggcaggttccactttcatgctgaggtcgggggtgatgtcaaagttggacagctctgcgtctacgtatgcgtcgacaacagacagcaggtatacaccgataaaggcgaagatgctcaagtcgcggtatcgtcggaaggtatccttacgcttccgtagtgtctccgtcagctggctttcggtatagttatagttgggaggcagcaggtcggtaatggtactggagttgaaattaccatttacggcatccttgtaggcggccgaatagtccttatacatcttgctgttccacgtaagggcataggcacaaccggcaaatcctccatagaagatgggcagtttccaatacttgcggttgtaaatttgtccaccgccgggaatgacgagggcaagccaggtggcttttgtgggattaggtacccaccttttggggtcgatggccttttgcagactgtctgtaggcacgggctgttccttcaggtcggggctggcagtcatttccagcatcttccgcttgttttcggctgcaagactgtcggcaacagtgaggctgtcccggttcaccacggtgttgagtgtatcggtctgatgccgctgcgcacgcttggaagcggcacgtggacggtcctgaccatacatagcaatccctgccatctgtaaaaaacagagcagcagggcaatggctaactgatatattcttccttttttcctcatttatttcttcagcgtatcaagaatgccgatgatacgttccaattcttcttcgttattgaacgggatactgattttaccttttcctttctccgagcaggttagctgcaccttggtactgaaaaagcccgagagctgttgtttcagcatattgaattcttcgggcagtttggcgcgcttgggggcaatcttacgaccaccgctcttcacgctttcgccttcactcagtgactttactatttcttccactttgcgtacggaatacccgtgctccaggatttcttcgaaaatcttcacttgcagtttgggatcgccaagcgttaccaacgcgcgggcatgtcccatgtctatctgcttgttctgcagtcccatctggacgggggcgggcagtttgagcaggcgcaggtagttggcaatggtggtacgcttcttacctacgcgttcgctgaggcgttcctgcgtcagtccgtattgttccaacagatgctggtaagcgagggctatttctacggagttcaagtcttcgcgctgtatgttttcgatgagcgccatttccatgacgttctcgtcatctgcagtgcggatataggcagggatgcttgtcagtccggcaagctgcgaagcacggaaacgacgctcgccggcgataatctggtattcgtcgtcgctaagcttgcgcagggtgatgggctgtatgatgccgatttcggagatggaatcggctaactcctgcaacgcaaccgggtcgaattcatgacggggctggttgggattgaccgtaatcttcgacagctctatctcattgatagaggaggagccttcggtctttacttcatccatggagaagagggcgtccagcccgcgtcctaatgcatttctttgtgccatctgtttatttactatttgacgatttacaatttaaccatacgggatgatttgtttgtgcattgtaaatatggtatttatcactaatcattaatcactaaccactataatcacttcttttcgtttctgcttatcaattccttggcaagtgccatgtggttcttggctccggttgagtctgcgtcatagagaatggtgggcaggccgtagctgggagcttcgctcagtttcacattacgctggatgacggtgttgaacaccaattcctggaagtggcgtttcacttcatcgtaaatctggttggcctggcgcagacgcgagtcgtacatcgtcagcaggaagccttcgatttcgagggcagggttcagcttggacttgatgattttaatggtattcagcaatttgctgatgccttccagtgcaaaatattccgcttgtacggggatgattaccgaatcggcggcagtcagtgcgttgaccgtaatcagacccaaagacggggaacagtctatcaagatataatcaaactcattcttcagcggagcgagtacttctttcagtatcttttcgcggtttttcagattgagcatctctatttcggcacctaccagattgatgtgggaggagattaccttcagtgtgtctatctccgtgtcatgaagggcctcgcgtacgtctacacggtcaataatgcactcgtagatggtacattccgactgcttgatgtccacacccaatcctgaggaggcattggcctgcgggtcggcatctacaacgagcactttcttttcaagcgtggcgagtgaggctgcgaggttgattgtcgtcgtagtcttgcctacaccacccttttggttagccatagcaattatttttcccataatctcaatatttattggcagcgaaataagtgataattccggatagcgcctacaaatttggagaaagattgcaaaaacggttgataagtcggctgttttgttaataactcacagacgtttaccgctgtttttcttcttgtaaattgcgcgtaaagcgttctttctctgtttagtgggcaaatatacgtatttatcttgaaatgaagctgattttttgtctcgcttgcagaagattaagatttgtaaaccaatggaagacattggcttggactattctctctacttgcatgagatgtacatctcgtgttgtttgaaacgtgcatctcatgttgctcgagatgtacatctcatgcagatggactaccgtgtggaagatggtcgggggataagttgttcccgggcggaaggagaggggctggtgtcagaccaaggctttgacgaactcccagcagaagtacgcacacatcacacatttcactactgtgcccagcaagaatccaagcagcgagcccagccccgatttcaaggcctggtctgtcttgctgcctcccatcagttcgccggcaaaggctccgagaaaggggccgaggatgatgccccaaggcatgaagaacaaccctacgatggtgcctatgaggcagccgcgcgttccccaccgactgcctccgctgtatttgctgcccagcatcgggacgaaataatccagtatctgtacaaggacgactgctgccagccataaaagtaactgcgtggtggaaaactgcgccttgtccgtgaaatgtagaagcaacaagcctgcataggctacgggcggtcccggaatcataggcaggatgcaacctgccaatccgacaatcaggcagaggatgcccaagatgatgagaagaatgtccataggtgtatcgtttctgttggtgaagatgacagcggttgttccctgctactcgaatcggttgtatatgacaatggggcgggagcggcgtgtgctcatcgacgggaaccatatatcgtcggctgtgaggccgcattgcttgatggcttcggcgcagtattccagtcgtccgaagtcggcatcgacattgtttgtaccgaatgtgaatttgattccacgtgctttggcgcgacggataatctcgaaactgggaatccggtagcgtgcattgatttccagagcgattccatgttgttgcaatacatccaatacgcgttcaatgcgtccgtccgtccagtacttgtcgtaatcatgcgccatagtatcgggcaagaaggtagggttggcataaatgtcggcaggctcgttggtcagaatcaggactgtttggtcgacaaggtggtccatatactgttcaagcgtaatgtcatcaaagagtgcttcttcggcccggtagatgcgcgagttacgtcccttgtggtctatgatggtcatggcgtcggtaaacaggtaatcgaaaatccccaaggcttcctgcgagaaagttgccgtccatttgcgtccctcaccttgtacaccgcacaggaatggcatcccttttacttcattaaaatagtcgtacacttctttgtcatcggccagcatacgtcctacgcctccttctccagcattgggggcgacaccatagttgataccgtaattcatggacatggcgtgtgccatttccttcgtcagccctcctttcaagtgaacgtgatagtctataactgggaaatcgtgctgctgtagcctgattatctcatccgtgcgctcgtctaccggagcaagcgtgtcggcttcgttgcgtgcctccttggcaagccgttcgatggcgagattccggaatgacacttcgccgtgtatgccttgcagggcaatggaaccttgactcagcagttgccgggcgtgctcctctgtgcgatatgggtgtccgggttcggtataacaaacaacttcggttccgttaatgcagacaatgatgttttgtccgcgtacggttatctcgaagtcaaaccattctccatcttttgcgagtgagcgatagaggttgcgcaccgaggcgagtgagccgctcttgcgtgtgccgtcgatgtctccgttacggaatatcacttcataaccggactcgccgtccgtatgaaagaggaggcctgcttcggagccgggttgtgtgagggcttctccggtgagtcggaaattttggtattctttgtcgttgaagagcttccggccttctgcaatgaccgggtctgccgtgtgaagcgtagatgtcccgtcattccattggtcaagtggctcgggagaactgctcctgccacagcttgtcagggttgttagaaacagaataattgcggcagctgccgtctcgatgcgtgcagcaatggtagaatggcaagaagtgttcattatagcatggattttatgaatgattatattccaattattgtcggtacaaagttagccttttctgaaaatatctttgaatacaaaagaattattatctttgtagtattctgtttaaagcctttttagctacttttgcacgataataaaaaagaaagttatggaaaatcagagacctttgatattgatttccaatgatgacggcatcattgcgaaaggtattagcgagttaatcaaattcctccgtccgctgggcgagattgtggtaatggcgccggatgcacctcgctctggaagtgcgtgtgcgctgactgtaacggaacctatccactaccagttggtccgtaaggatgttgggctgacggtatacaagtgttccggtacgccgaccgattgtgtgaagctggcttttcatacggtgctcgaccgcaagcccgacttggtggtaggcggcatcaaccacggcgacaattcttctgtaaacctgcattattccggtacgatgggcgttgtgatagagggatgcctgaaaggagtgccttccatcggattctccctttgcaaccatgagccgaacgctgattttgaacctgcaggtccttacatccgcgagatagcccggctggtattggagaaaggactccctccgttgacatgcctcaatgtcaacttccccgataccaaagaattgaagggtgtgaagatttgcgaacaaaccaaggggcaatggaccaatgaatgggaaaactttgcccatagaggagatgcccattactactggctgaccggcgagtttgagaacaacgatgccgaaaatgagaagaatgaccattgggcgcttgataacggttatgtggcaatcaccccgaccacggtggatgcaacggcatacggcttgattgatgaactgaaagcatggttctgaattaattgacaattatcaattgatatgaagtattacttgattgtcggtgaagcttccggcgacctgcatgcctcccatctgatggctgcattgaaggaggaggactcgcaagcggagttccgtttcttcggaggcgacctcatggctgcagtgggcggtgtgatggtgaagcattacaaagagttggcgtatatggggttcattcccgtactgctgcatctgcgcaccatctttgccaatatgaagcgctgcaaggaggacattgttacgtggcagccggatgtgctgattttggtggactatccgggctttaatctggatatagccaagtttgtccatgccaacacaaggattcctgtcttttattatatttctcccaagatttgggcatggaaggaataccgcatcaagaatattaaacgggatgtggatgagctgttctccatcctaccgttcgaggtggagttttttgaagggaagcacgggtatccgatacattatgtcggcaatccgacagtggatgaagtgacggcttttcttgcttccagctcagagacattcgacgactttgtccgggcaaacggactttcggccaaacccgttattgctctgctggctggtagccgcaagcaggaaatcaaggacaatctgcccgacatgcttcgtgcggcagcttcttttcccgattatcaactggtgctggccggtgctccgggtatttcccccgagtattacaaacgttatgtgggtggggtggacgtgaagattatcttcaacaagacattccctttgttgaggcaggcagaggctgcactggtcacttcggggacggcaacgctggaaacagctctgtttcgtgtgccgcaagcggtatgttaccatactccgatagggaaggttatcgctttcctgaaacggcatatactgaaagtgaagtacatttccctggtcaatctcatagccaaccgggaggtggtgaaagagctggttgcagataccatgacggtagagcaggtacgctcggagctgaaccgcattttgtacgataaggaataccgccgtcagatgctcgagggatatgagtatatggcatcctgtctgggagaggcaggggcacccaaacatgctgcccgcgagatggtggcattactgaggaggagggaagaataatcgaaaaattaagaatttgttaaaatgggaaaagccggtgcagtaaatgcccggcttttgtattttctatatagaaacaaatgaaaaggactttgattatgaaaaagctacattggttatttatggcaatatgtttggcagtgatgcccgctttgcaatcatgtgatgataacgacggatattctttgggtgattttaccccgcctttgtgggccactgtgcgtgttacgggaaatgccttttatttaaactgcgatgtttgggggacgctctggccggtgaatacggacatagggtggtatgatgctgtggatgggcagcgtgtgattaccgtgttcaatcctttgtgggacaactatgcaggatatgaccatgctgtgaagctgctgcgtctgcagaacgtcttgacgaaagaggtggagacgctgactcccgaaaccgaagaggaatttggtaatgaccccgtgtttatatataaaggtgatatcaccatcagtggtggctatatgaacatttttttcatgcagaacctgccatcttcgactgataataaacaccgcatcagcctggtgcgtccgcaagaagatgatgctttgtatggcgaagatggatacgtccatttggaactccgctataacgattatgatgacctgacgggacgtcgtagtcctggtgctgtctcctataacttgaacagtctggacatcccctctgaaaccaaaggcatcaagttgaaactcaattcagaagagaatggagaggtggaagtaacctttgatttgaaaactgcggggagtaatgaaaagctgactactaatgtggatttgtccaatatgcagttgaagtaagaaagagtttgcgagagtatatagttagaaagagcacccgggattttgatgtcattcatcttgcccgggtgctctttttatatttgttttatgtaagtttggtcatgtgagccgtcgttagaacatcgtcaaggcatatagataaacaactgctgcaggaattgccatcagggcactgtcgaaacggtcgagcatccctccatgccccggcagaatgttaccggaatccttgatgcccaattggcgtttcatgagtgattcggtcagatcgccccaagtgccgaaaatgacgacaacgattgccagacctacccattgccatcctggcataaaaggaaagaaatgtgcaaagccaagagaggaagcgatggagaatattccgccgccgatgctgccctcccaggattttttaggtgagatgcgttcgaacagacggtgtttgcctatcagcgaacctacgcaataggcacctgtatcgctcagccagataaaaacgaaaatggaaagcggtagaatagggttgtaggtcacactgcccgtttccggggaattctgaaaagcaagtacgttcagcagggcaaaggggagtgccacgtacaattggcttagcatggagtaggcccagttacccgtcggattctttttcttgaggtaaagttccgtaatcatcatgtagagcaatagtcccaaataaggaaggaatactcgtgctcctacagactgctgggtacagaaactcatcaatgcaaggaaaaggtaggctccccccaatgcagtgatggtcttgtttatgcttacttcgccgctcttgctgactaattgggcaaactcatgtacgctcagtgcgttgataatggtgaacagtataccgaacgaaagggggctgtaaagaatacagcccaccaatactatgacgaataacacgccggtaacggcacgttggataaagttatttttcatgcttttcttcttccttgacttccttttctgcttctatggctttttgctcttcttcttgctccgcttttttcagttcggcagcagtcttgtttgcactgatttcttccgaacgggaagcccatggacgtttcccaaagatgtgttcaacgtcttcggcaaagattacttctttgtcaatcagcagttgtgccagccggttgtgcccttcttggttttcggacaatattttcttggcacgttcgtactgttcattaaccatctgcttcacttcttcgtcaatcaattccgcagtcttttcgctatacgggcggttgaaggaatattcctcattattataatagcagaggttgggtagtttttcgctcatacccagataggcaatcataccgtacgcctgctttgtcacgcgttccaagtcattcatggctccggtggatattctacctaagaataggtcttcggcggcacgtcctcccaaggtggcacacatctcatcgagcatctgttccttagtggtgatttgccgttcttccggcagataccaagccgcgcccaaagcgcgtccacggggtacaatggttactttaatcagcggattggcgtattccagtaaccaggagatgctggcatggccggcttcgtgtatagcaatggaacggcgttcggcttcggtagtgattttggttttcttttctaatccccccacaatacggtctacggcatccaggaagtcttgctttccgacgaacttcttgccgtggcgggcggctatcaaagctgcttcgttacatacattggcaatgtctgcccccgagaatccgggagtctggcgtgccagaaggtctacatccacactattgtctatcttgatggggcgcaggtgtacaccgaatacttccttacgctcattaaggtcgggtaggtctacatgtatctggcggtcaaaacgtccggcgcgcagcaatgccttatccaaaacgtccacacggttggtggcggctaagatgataacaccactgttggagccgaaaccgtccatctcggtcagtaactggttcaatgtgttctcgcgctcgtcgttgccacccatagcggctgctttggcacgggcacgccctacagcgtcaatctcgtcgatgaacacgatacaaggcgctttttcctttgcttggcggaacaaatcgcggacacgggaagctcccacgccgacaaacatttccacaaagtcggaacctgccaaagagaagaaaggtacgttggcttctccggccacggcctttgcaagcagggtctttccggttcccggagggcctaccagcaaggcgcccttgggtatcttacctcccaaatcggtatatttctggggctctttcaagaactcgacaatttcttctacctcttgcttggcttcagcaagtcctgccacatccttgaatgtaatcttgatgggggaacctttttcaaacaattgggccttggactttcctacgctgaagatgcctccaccaccgctcatgcggcgggacatgaaaatccagaaaccgataaggaatgcaaaggggagaatctgccacaaaatggcaccgaagtagttccgctttttttcgtagttaatggagccgtcaaagtgggcgtcgtctctttccttttgcaggaaattacctaggctctcgcgtgagggggcctcggtcgtaataagcggattcttgcctacgcggctggagtcctggcgaaatacgtttcctacgtgctggggtttgacgtatgcttcgacggaattgtcgtcgtagccgatgactttgcttatataaccgtctcgtacatattgctggaattcatcataagagatgtttttagttgccgtaccactttcattggtcaggtacaaccccagcaacatcatcgctataatcatatacagccagttcaggttgaacttgggcatattcactttattgggtttcttgttggtattattgtccatacgttttgattaatcgaggtcaggaatttgagttaatttggcgtctgcccataggtgctccagattgtagaattcccttgtttcaggcaggaagacatgcaccaatatgtccgagtagtccatagctacccattcggcattgcgcagcccgtctacggcaaagggcttggtatcggcacccttgcgtgtgaagtccctgatggattctacaatggctgtcacttggctgggagagtttccttggcagatgacgaaataattgcatattgtatcgtcgatttttgtcagatctgcgatgacgattttttttccttttttatcttgaataccttctgttatctgttgaatcagtttcttcgtttcgttcattatacattattatattaaaacagttgacaaatatacgttgatttctcatatcaaacacgcaaaagaggaaaactctttcaatttttgattttttttagttatataatcctttggattacggtatcttatcagttttttgcgaaaaaaatactcgtttttgttttgatttatagaaatctttgtatctttgcaaccgcaaaacggaaataataacaattgggctatggtgtaatggtaacactacagattctggtcctgtcattcctggttcgaatccaggtagcccaacgaacttaccttatttaagtcaaaaaaccactaaaatcgcaagttttagtggttttttgttgcttttcgaccatgtacgaaaatttcagtgtaggcattcggtggcaaattcagtgacaaggcttctgtaagccggaaatattctgtaaatttgtagcatttcaacattaaagcagaattttatggcaaaagaattagcactgaagtacggctgtaaccctaaccagaagccggctcgcattttcatgcaggagggggagttacctattgaggttttgaatggacgtccggggtatattaattttatggatgccttgaatggatggcagttggtaaaggaactgaaagaggcgaccggtatgcctgctgcaacttcattcaaacacgtcagtccggcgggtgccgccatcggcttggaactcaacgagacaatgaagaagatttattttgtggataatcttccgctctctccgcttgcttgcgcatatgtgcgtgcccgcggtgccgaccgtatgtcttcctatggtgactttatcgctttgagtgatgtgtgcgacgaggctactgtacgttttattaaccgcgaggtctcggatggcgttattgctccggggtatacggacgaagcactggctatcttgagggaaaagcgtaaaggaacttacaatgtgattcagataagtcccggctataagcctgccccgattgaacataaggatgtctttggtatcacgtttgagcagggacgtaatgagataaagctgaatggagatgaactctttgcgaatattcctactcggaataagaatttcccggaagcagcgaaacgtgatttgatgatagcccttatcactttgaaatatacgcagtcgaattctgtatgctatgtgaaggacggtcaggctatcggtattggtgccggccagcagagccgtatccactgtactcgcttggcgggcaacaaggccgacatttggtatttacgccagcatccgaaggtgttgaatttgccatgggtagagaaaatccgccgtgccgaccgtgataatacgattgatgtctatatcagtgaagaccatgacgatgtgctggctaacggtgtttggcagcagttctttacggagaaacctgaagtgctgacccgtgaagaaaaacgggcttggttggatacattgaaaggtgtttctttgggttcggatgcattcttcccttttggagacaatattgagcgtgcccataagagtggagtagattacattgcccaagcgggtggttctgtacgcgatgaccatgtgattgaaacttgcgataaatatggcattgccatgtcgttcacgggtatccgtctgttccatcattgataaggggtataaaagtaggcccgcccccacggctgcatagctgtaggggcgggttccttttttattaagtcttatcttgttacgttatccttggtttttgatgttctcgtccaccacttttatcttttctttcacaagctcgatgtctgctttcagcttttccaccttgcggttgatttctgtcagcagactatttcccttcttggaagaagtggtcaggaagccgagattgttttcatatgtctggagctcgttcttcatattgtcgaaggcacgtaccagcttctcacgttcccggtaaagggcttgtggactaccttcctgaatggagctgatagtcgacttgaaattgcttagcttcttgttggaggcactgatgttgaagcgttcaaacaatttgtctatctgactatggtattgcttatagattcggtctttctctttgaaaggtacatgtcctacgccgttccattctttcatgaggtcgcgtaccagttgggtagcttcctccgtatccatttggtcatcgatagcattcagtttctcgatgatgttttttttcttttccagattttcctgctctacgctgcgctgtgaagaagtggctttgttcttttgttcgaagaagtagtcacaagcggagatgaaacgtttccatacggcatccgaatatttctttgctaccggaccgatggttttccattctttctgaagtttggtcagttcatcggcagttactttccagtcggtactgtccttaagagcttctgctttttcgcacaaggcacgcttcttttccaggttttcgttcataccttccttcagggtcttgaagaactctccctttttacggaagaactcgtcgcacgctttgcggaaacgttcgaaaatcttcacgttcattttttgcggagcgaaaccgatggtcttccatttgttttgaagtgcgatgacttcttgcgttttgctctcccaagaagcaaagtttgtcagttctttgtagtcgatggcttctatgatttcgcaaattacggtcttttggtcaagattgtgttgttccacttccttcaacgcttcgaaatgttgctggtgacgtcgatttacggttgtagaggcagctttgaaacgtgcccagatttcgtcgcgtagttccttggctaccggccctgtatcacgaaattcttgatgtagcttctgtaactgatggaaagctgaaactacatccgcttcatccgccagcttttcggcagcttcacagagatgtgtcttgatttccaaattcttcttgaaatcgtattcgcggaattcattgttcagtttcagaaggtcatagaatttctcaacatacaattggtagtttttccaaagctcgttgaccttagcttgcggaacgagtttaacttcgttccattgctgctgtagtttcttgaactccgtatagctcttgttggcgtcatctggagattcaaccagctccttcagctcttcgatgatggaaagctttacctgcaggttcatttccttctgcttctccagttcggctgtgagtgcgcttcttttttctttgatgacggacatgatattcttgaactcttcttccacactgtctgtttgtggaacaaagttctccgcggcgcctccgttttcaatgaacagttttctggccgcttcctgctcagcattgtgcagcttgtagaaagattgcttcaaaccgtctatttcaggttttgccacgttctctacgtctgcaaccacctctttgagtttggcaagtatttcctctttcgtgagcttctgaactggctctaccggcttttccgaaacgatttcttcagcgggagtttctgttgttgccggttcagaaacctctgctgccttcttttcttcttctaattccaccggcttttcggggagattagtgtcatgagtgtccgtcattgtatttacttttttagaaacgggttcctcccgttcgggttacattaggctacaaattaatgaaataaaatgattacttcatacaatttgccttgatttttttctattttcttgtttttatgacagtaagacagtgatacccatgtacagcatcatgcctataatgtcattggtaatggagataaacgggccggtggcaatggccgggtcaaccttcagtttctctaaagtcatggggactagcgttccgaagatggaggcgaacatgacgactgcaaagaggctgatggagacggaataagtgaccgtagccgtagctccgaaccggataaaattatagatgtataccagcagggagatgatggtggcattgatgaccgccactactgcttccttggctacctgcttgaaggtgtctttggcatccagtgagctgttggcaaggccttgcacgatgatggcagacgactgggttcccacgtttccccccgtaccaccaatcaacggaatataaagggccatttccggatgggcggcgaaagtcgtgtcgaagttacccaatatcatggagttgcctataccacctaacataccgataagtaaccatggaaggcgggcagaagtctggcgcatgacattatcgtccgtttctacatcttgggacaaaccggatgccaactggtaatcacgttccgactgttcgcggacttcgtccatgacgtcgtctacggtaatctggcctaccagacgcccgatactgtctacaacaggagctgccaccaagtcatacttttcgatgatttgtaccacttcgtcaatgggggtatctacatggacggagataggatctttccgcatcacatgctttaccttggagacagaaggggaagttatcattttcttcaatgggaataccccttgcagacggtcttcgtcgtcgatgacgtatacgtagtaaatttcatccagcttttcagcttgcaggcgcatttccttcaggcactccggcatactccagttttcattgacagtcaccatttccgtacccatcaaaccaccggcagtgtcttcatcatatttcagcaggtcaacgatgtcaccggcttgttctatatcttcgatgtgcgaaagtacttcctcctgcttgtcttcatcaagttcgcgcatcaggtctacggcatcgtccgtgtccatataatccacgaaacgcttggcaatggtctccgaaggaagaagttccaggaattctttccggatgtcttcgtccatttcaaccagtacgtccgctgccgtttcgttgtcaaggaggcggtaaacgaagcgggcttcctccaagccgaggtcattgcacagttctgcaatatccgccgggtgaagatcggtcaaaagtgttttgacgttttccgcgtctttctgttctatcaggcttttgactttgtctatgtattcttcgtctatttccatgattgttcgtgtttaatcactagccattaatcattaatcgttctcaatgcctgttccacttggttggtcagctgaataaattcctgtacggacagttgttccgggcgtttattaaataatacgtcctccgtcagtggacagtctttgccgagtatcggttttatggagttccgcagagtcttgcgtcgttggttgaacgtggttttcactacttgcttgaacaatttctcgtcgcagcctaaatcgtgcgtttcattgcgcatcatgcagatgacggcacttttaacttttgggggcgggttgaagacatgttcgtgtaccgtaaacaagtactccactttgtaccatgcttgtatcagtacacttaggattccgtatgtcttgctgcccggcccggcggctatgcgctcggctacttccttttgtatcatacccgtacagcagggaatcagatccttatattccagcattttgaagaatatctggctggagatattataaggatagtttcccgtcagcacaaaaggttgcccgccaaacaaccgttgcaggttcattttgaggaagtcgtcctcaataatgttgtcttcctgttgcggataggcttcccgtaggtaggccactgactcgtagtccagttctactactttgacgttgcgttctttgggcagaagaaactgggtcagtactcccattcccggaccaacttcgaggatgggaatttcgggacagacatctaccgtgtcggcaatgtcttgtgccactttcaggtctttcaggaagtgttgcccgagaaactttttaggtttaactactctcatgtatcaactaaatcattacttttgctccgtaaacgtaggctgtagtgtgaacaacaacctatctttacacggagcaaaggtagttcttttcaatgaagaatgaagaatgaagaatgaagaatttgggaatatcgtatgaataagctgctaaaaaagacgttgaaaatcatcttacccattttattgggtggttttatcctctattgggtatatcgtgattttgacttttcaaaggcagaagaagttctccttcatcagacgaactggtggtggatgttgttgtccttgttcttcggtgtgatgagccatgtgttacgaggctggcgttggaagcagactttggagccgctggatgctcatcccaaaacaagcgattgcgttgatgccatttttgtatcttatgccaccaatctggtactgccccgtgtgggagaggtttcgcgttgtggagtacttgccaaatatgataatgtttcctttgcaaagtccctggggacggtggtgacggagcggttggtagatacgctttgcattctgctgattacggggattacttttttggcgcagatgcctgtctttttccgttttttcgaggagacgggcaccaagattccttcgctggtgcatcttgtgacttccccttggttttatgtggctcttttttctattattggtgttttggtacttctctattttctgttgcgtatgctttctttttttgaaaaggtaaagggagtagtcttgaatatatgggaaggtgtgatgtcgcttaagaatgtgaagaatgtgcctttgtttgttctttacactttacttatttggctatgctatttctatcatttctatataactttctattgcttccagtttacggagcaccttagtttccttgccgggctggtgatgtttgtcggcggaacgtttgcagtcattgttcccacgcccaacggggcaggaccctggcactttgctgtcatcactatgatgatgctttatggggtaaatgctacggatgcgggtatatttgctctgatagtgcatggcatacagacgttgctggtgatagtgttaggcatctacgggtcgttgcacctggcattggcgaatagggcaaagaaatagacgtttcttgtggtgggttcctatattgtcacttcttgtgttagaggacagagacagtacttatagagagtactcctttaaaagtactgtaatacttctttgcaagtacttcagtacttccttataagtactgaagcctaaaggttgttggaagattggtttctttaaacgatattgttgcttggatatagaagtgggagaaattcctaaatatggtagctatattaggtgcagatgttctatcgcaatatgtgaagatgtaaaagccatgtttaagatagctgatgatttagtactttagaaaaatcccggtttattgtactttccgggaataaaccgttatatttgcgaaaactaactttttagaattatgagtacaatcttacagttagctccacagaatgtatggaagcacttttattcactgacccagattccccgtccgtcaggacatatggagaagattaccaaattccttattgattttggaaaaggcttggggttggaatcatttgtcgacgaggtcggcaatgttattattcgtaagcctgccactccgggtatggaaaatcgcaaaggcatcatccttcaggcgcatatggacatggtgcctcagaagaacaacgatactattcacgattttacaacagatcccattgaaacctatgttgagggtgattgggtgaaagccaaaggaaccacgctgggagcagataatggtttgggagtagctgccattatggcggtgctcgaagataataacttgaagcatggcccattggaagctctgataaccaaggatgaagaaacgggaatgtatggtgcattcggtttgaaacccggaactatgcaaggggaaattctgctgaaccttgattctgaggacgaaggcgaactctatatcggctgtgccggtggtcttgatattactgctactttggaatataaggaggagacgcctatggccgatttcgttgctcgtaagattacgctgaaaggtttgcgtggcggtcactccggtttggaaatcaatgaagggcgcggtaatgccaataaattgctggcacgcatcgtacatgatttgctgattgagtttgactcccagctggcaagttttgaaggtggtaatatgcgtaatgctatccctcgcgaagcacatgcagtattggtgttcaatcttgaggatatggacggtttggaagattatatgaaggaatacgaggcacaactgaatgacgaatatgctccgattgaaagtggtattaccctgagtatagaagaggtaactctacccactgccgttgttccttcagaaatccaggataatatgattaacgtgttgatggcttgccagaatggtgtgatgcgtatgattcctactgttcccgatactgtagaaacttcctccaatttggctatcgtaatcattgcagacggtaaggccgaagttcgtattttggcgcgtagttcttgcgatacgatgaaggatttcctggcagacagcctgacagcttgtttcgctatggcaggtatgaaggtggaattgagtggtggctattccggatggcagcctaatgtggattctcctatactgcatgccatgaagctgtcctataagcagcagtttggtgtggaacctgccgtgaaggttattcacgcaggtctggaatgcggtattattggtgccaattgtccaggactcgatatgatttctttcggtcccactttgcgttctccgcattcaccggacgagcgtgcgttaattcctactgtttccaagttctatgatttcttggtggctacattggagcagactcctgaaaagtagagaatactttatgtaatgaataggggcagggtgctttattaagtatcctgccttttttgtctgtgacagtttgtcccctttctgccagaatgtcccagacttattacaatggtatgtcaatatccttgcactttctccctaaaaattgacctaagtcaagaaatgtgttataaaacatgttttctatccgttttttgcttgttatcttgaacaaaggctctatttttgtgttgtaaaacatgaaaacaatagaaaactagtagattttttaaggataacaagattgattttaggaggataacaaaatgaaaatgttaaagagtttttttaagcatgtcggcgaagccgataagaacatttggggttacgtaatgctttaagcattccccccctttcgtgaagtattgaattttagttttcaggtattagtttaattttttaagattatgaaaaagaagattgcaaattcatttaagcacattcttaccgcagctggtaagaattggatggaggcaatgagatattatagcctccaaatgtgagtacactagcatttaagtatagcacaagggatatgtttgcaaacatatcccttgtttttttgtaggagtagaataagattttttatgtccaaaagtacatttgtttgaactttattcacttcctttgttattaatacaaagactaacaaacgaataattatgagagtaattcaaagaatttgtagcatattgttgctgctggttacatttggggcttcggcattgtatgcgcagacgtacgataagttgtggaagcaggtggagcaggctcaaaagaaaagcctgcctcaaacagtgataaaactggctgatgaaatctatcggaaaggtcggcaagagcagaatgctccgcaaatgttgaaagcctacatttgtagggagacttatcaagaggggctgactccggacagcctttactccagtctgaaatatatggaatcttgggcacaatcggagaggaatccggtgaacaaggctattctacattctttgttggcatatgaatatgctgacttgatgcggaagaatcgccgtgtcttgctgtcacgtactttactgactgttgacgaggttccagaagatatccgtgagtggagtatcagccagtttgtggataaaatagataggtgtaaccgtgcatccttgcaggattccatccgcttgctcaatacatctgcagaacaatatgtgccttttgtggtgttggaagacggtagccggttctatgggcacgatatgtaccatctattggtaagccgtgctgttgatgcttatcggcagctggatggtttcagcgtggattctttggtacagacccgtatcgaaaggatttatctggatatgatgaatgcttatcgccatcgtgccggttcggaagatgctatgttgctctgttctcttgattattggaactggaagttgaccggtggtatcagccagcagccttatcctactttccgaatgcgtcaggaaaaggctaatcgggaatatcttgaggttttggataaattgataaaggaatacggttcacgagaggtttgtgccgaggtttacattcataaagccaaccacctgcgccgtttggaaccgaaacgcgctgatgaggctctaaaagtctgtgaagaaggcttgaagcgctatcctgcgtataagcgtatcaatgagttgaaaaatatccgtgaacagattttacagcctgaactcattctgactatgaatgaaagcggttatcccggcgattcggtgaatatgaggctgcattatcgtaatgtcgagggcttcactctcaacttatataccactactttaagtgaagtaccttggatggaccatggtataaataaagatacttatagaaagtatgcccggaagttttcttccacgcattttggcttaaagccgttgccaggcaaggataaattgcctgaagatgtcccttatcttgcctcggacactgtatttaagttcatgattcctcgggaaacgggagtctatattcttcaaatagtacctgatactgaaacggcccgtacagatgataaatttctggtatctacccgcttcaaggtgctgacattggatttgggtgacaaccgtatggaagtggctacattggatgcccgtagtggacagccgattgctggtgccaaggtgagtttctactcttcttatgatgagaagaatagaaaagcgatggcagaggtactgactgatgccggggggaaagctgtattaccctggcagagtgaaatccgaagttatgtggcgcgtaaaggcagagacacagccatgatgccgcagaacgtttatatgaatcatccttattacggtattaaggatacagattggaggcagatggcattgctgacagaccgttcgctttatcgtcccgggcagaccgttcatgtaaaagggatagcttacaagcagaatagtgatagtgcccaggtactacaaggagttgattatgagcttgtcttgttggatgccaaccgcaaggaacttgccaccaggaaggggcggaccaatgatttcggctcttttgctacggagtttgtacttccggcagcttgcctgaatggcatgttcagcatacgaaccaaagagcctcaatctaccgtcacttttagggtagaggagtacaagcgacctacgttcgagattgccttcactccggtttcggaagcttatcggctgggtgacaaggttgtgttgaaaggaaatgtcaaggccttcaatggcatgatggtgcaggatgtgccattggcatatacggtgactcgccggaatccgagacctggttattggagcaatgctgataaaccattattgtctgacaccatacaattggataccaacggggatttttccatacccttgactttggaagctccggctgtagatacagacgggtatgggagtgtgtatacttatcatgtggaggcggtggtgacggatgaggccggtgaaacgcaatccgcttcgtataacttgttggcaggtcctaaggcttattcctttgatattcgcttgcctcaatatgtttgtaaggaagacagtatgcttttcacttttggagtgaataatgtaatgaatattcctcagcacattgaaggttcctattgcctttatccatttgcagaacaaaatggggcaaggaatattgcaggttctgaacccttggatgatgttgtattggagggtaccttcacagccaatcggctccaggatttttcggcttggaacaagcttccttcaggtaactatcgcttgaaactttctgtacgtgatagtttgggacgtgaagagaataacggggcatatggcagtgacagtttcatgctcttttcaaagagtgacaagcgtccggctgcgtttacagatttcttttattataaagaaaatgaggaatttgatgtacagtaccctgccgcttttcttttggggacttcttatcgggatgcatatgtgctgatggatgtcttttgtgacagaaaacgcattgaaagccgtgtgttgcagttgaatgatactattattcgtatggaattcccttataaggaagcatatggcaagggaatcaccattcttttcagttttgtgaaagctggcgagatgtacagtcatcaggttgaactgaagaagcgggagccggaacgtgctctcgacatgaaatgggaagtgttccgtgaccgtttgcgtcccggacaggaagaagagtggaagctcgtcataaagacgcctcaaggtatgcctgctgcggctgagatgttggctacgatgtacgacgcttcactggataagatttataagagtaaccagatactacgggttttctatccggataatctgtatggggcattccgtggtgcgagccgttataatagcaattacttctccgtttatttcccgttgaaggcttggagggttccggtgtggtcgtttgactacttctgttctccttatatggatggaaggatgcggatagtgatggtagaagacaatgcgcttttggaagaagtaagtgttgtggggtatgggactacccggaatagctctttgaccggtaatcttagaatacgtggtgccaaccagccgatgcttgcttccaaagcagaatccgggaatgccgttgaagtgaaatatgttcctgcacaagtagcggaagacgcggtggaagatgttgtttttgaatcggaaacgataccggttggcgaggccttgcaacctattgaggggcttcgcaccaactttgccgaaacagcctttttttatcctcaacttcgtacaaacgaacaaggggagcttgcgttttcttttacgatgccgcagagcttgactcgttggaatttccgtggttactcacatactaaggatatgctgactgggatattggatgcttccgttgtaactgccaaggagtttatgctgactccgaatatgcctcggtttgtccgcgttggagataaaacacagatagccggaacaatagccaatctgacgggtaaagcggtgaaaggaacagcagtattcacactgttcgaccctatgacggagaaagttattgctactcaacgtcagaaattcttggtagaagcaggaagaaatactgctgtcaacttccatttcgaagtgtccgaccgctatgatttgcttggtattcgtatggttgccgatggaggtacgtttagcgatggcgagcagcatctgttgcccgtattaagtaataaggagtatattacggaaacgcttgctatgcctatccgtggcgaggagacccgtacgttctcattagacagccttttcaaccgtaatagccgtacagcgacagaccgtcgtctgactgtagaatttaccgggaatccggcttggtatgctgtacaagcgttgccggcattgagcctgcctgccaatgataatgccatttcttgggctacagcttggtatgccaatagtctggcaggcttcattgccaacagccagccccgcattaagactgtatttgacagttggaaggctgccggtggcacgaaagaaaccttcctcagccagttggagaagaatcaggatgtgaagaatatcctgctcagcgagtctccgtgggtactggaagctactactgaagccgaacagcaggcacgtattgccacgctgtttgatatcaaccaactgaataaccgcaatctttccgcttttaccaaattgaaagaattgcagggtgaagacggtggatggagctggtataagggaatgtccggtagccgctatataactggctatattacagaattacttgttcgtcttcctctgctgacgaaaaatgaactgtctgaagaagttgccgccatgcggcagaaagctttcggctatttgaatcggcaggccttggaagagtatcgcaatatccgtaaagccgaaaaaaatggcgccagaattactgccaactccgaatcggcaatgacatatctgtatctgatagcccttagcggcgaacaagtgccggcagacaatcaagcggcttaccgctatttcctatcaaaagtaggtgccaatcttaaagatggaaccatgagcagcaaggcgcagtctgccatcatcctgaaagcagtagggcgtacagccgaggcgaatgaattcatcgcttccctcaaggaacatctggtacagacggatgaactgggtgcatactttgctttccaagcaaatccgtataactggggtatgctgcccatccctgcccatgtggaagtaatggaagccctgcatatggcaggtggcaacgatgctttggtggaggaaatgaaactctggctgctgaaacagaagcagactaccagttggaattctccggttgcaacggctgatgctgtttatgcattgctttgtcaaggtactaatctgctggaaagtcggggagacgtacgtatcacgttaggtaacaaagttttggaaacattgtcgcctacaaagaccataatcccgggtttgggttatgtcaaggaaaccttcgctcaaggaagtccggagctgaaagctaaaaccgtcaccgtagagaaacgggatgcaggcattgcctggggagctgtttatgcccagtatctgtcacccatatctgatgtaaagcagcaggggggtgaattgaatgtagagaagaaactttatgtagagcgtatatcggccggtggtagcaagtccttgcaaccggttacggaagggaccgtattatccgtcggtgataaaatagtggcccgtttgactatccgcttggaccgtactatggattttgttcagttgaaagaccagcggggtgcctgctttgaacctataggctcgctttccggttatcgttggagtaatggcctcggttattatgcagaagtggaagatgccgcaaccaatttcttcttcgaccatttgggcaaaggcgtttatgtcttagagcacagttatcgcatagcccgtggcggaacatacgaaacggggctggccacgatacagtgtgcgtatgctccggagtatgcttcgcattcggcgggagggataattgtaataaagtaacaatagagtatggagcggagcgcaatttgtacaaattgcgctccgctattttaggtactctcgctaaaaacacctatttttgtccgactaatattgaatgagagtggcagaattaggaaatcttgatattaagaaaaatagatgaagcggatattgataactttatatgtgcttgcaagtgtggtattgactgctgtagcgcaagctcgttttacctcgaatacagagatgtacagtttcggccagatagaatggaagcatcccgtgactgtgcaatataccatcaccaatacgggtgaccagcctttagtgcttacagaagtagagccggattgcgcctgctctgtggcccagtggacaaaaacgcctattgctccgggggcaaaaggaacagtaaatgtgacttttgacgccaaggcattgggacatttccagaaatccgtggctatttacagcaatgcgcaacccaatctggtctatttgaagttcaatggtgaagtagtacaggaaatcaaggactttaccaagacgcatccctatcttatcggtcagatacgtattgacaagaacagcctcgacttccccgatattcagcatggtgagcagccggtgattcatatcggcgtggtcaatctttccgaccgtccttatgaaccggtactgatgcatctgcccccttatttgcagacaaaagtagaacctaacgtgctgcaaaagggagaaaaaggagtgattacacttacattgaattcggaaagactgactgacctcggactgactcaagcgtcggtctatctttctcgcttctccggtgacaaggtgggcgatgaaaacgaaattcccgtttctgccattcttttaccggatttctccggaatgacggaagtggagaaggcaaatgctcctgtcatcagcctttctaccaaagaagttgatatgagtgcgatattggccaagaagtcaaaagcacgtcaagatattaccattaccaataccgggcgttctcctttacagataaacaagctccaggtattccacccggcagtgggagttaacctcaagaagagtgtattgcaacccggtgaaagcactcgcctgcgggtaacggtagtgaagaagaatataggcaagaagcgccgtcatctgcgtctgctgatgattaccaatgacccgatgcagccgaaagttgaaatcaacattaaagcaaaacaataagaagtcgtaaagtccttcataactcataactcataacttataactcacaaatagccatggaacatcccgaaaataatgaagcatataaaggcttggttgtcaatgcaggcattgagcaaccttcatcggtcaatccttacttgaagaaccgtcccaggcggaagaaacgcgagctttccgtatcagactatgtggagggtatagtgaaaggtgatgttacggtactcagccaggctgtaacactggtggaaagtgtgaaaccggagcaccaggctgtggcgcaggaggtgatagagaagtgtttgccctattcgggcaactccgtccgtgtgggtatcagtggtgtgcccggtgccggtaaaagtacctctattgatgtatttggcttgcatgtactggaggaacacggcggcaagttggccgttcttgccattgacccgagcagcgaacgcagcaaaggcagtattctcggtgataagacgcgtatggagaagctctccgttcatcccaagtcctttatacgtcccagtccctctgccggttcgctgggtggcgtggcacgcaagacgcgtgaaacgattgtgctttgtgaggctgccggtttcgacaagatatttgtagagacggtaggggtggggcagagtgagactgccgtacattctatggtagacttcttcctgctgatacagctggcgggtacgggcgatgagttgcaaggcatcaaacgcggcatcatggaaatggccgatggcattattattaataaggctgatggcgacaatctggagcgggccagactggcagcaacgcagttccgtaatgcgctgcacctcttcccggctccggagagcggttggacaccccaagtgctgacttattccggtttctataatcttggtgtaaaagaagtgtgggatatggtctacaaatacattgactttgtgaaagataacggctattttgaataccgccgcaatgagcaaagcaaatactggatgtacgagaccattaacgaacagctgcgcgacagcttctaccacaatccgcagattgaagcgatgctgactggcaaggaaaaacaagtgctacagggcaacttgacttcttttgtggctgccaagaacttgctggacacctattttgcagaactgaagaaataagggcatatccctttccctatatcgatgactaaggaaaacaacatggaagtggcgcggcggtttacccgccgccttcatgaactcccttctgaggagctggagctcattgccggtttgtttgtacgccgtgaggtgcacaaaggagaactgttgattagtgagaaagatatagccagggatattgttttcgtagagaaaggactgcttcgccagttctatttcaaagaaggccgggacattacagagaactttgcctgcgacggtgacggcgctatgtgtatcgtcagccttttcaccggacgccgtaattgccttcagctggaatccctggaggaaggcgtcatctggagcatttcgtatgcaggactggtcgaactctctgagcgttatctgcatatagcccgtctgcttcgccatttattggaggggtctttaatgctttcccaatataaagcagactcttggcgtttcgaaacctcacgcgagcggtatgcgcgcttcgtcagggattatccggagatagcccggcgtgcctcagtcaaccacatagcatcttatctgttaatgactcccgagtctctgagccgggtacgtgccggagtactgtgacggtggaacggctgttttatacggctttcccttctttctcgaaatccttgcgtgacttgctttgtgtcacgatgtacactcccaggaataccaaggctatggctattcccttttccaaattgaacactcccaatcctaagatgatggcaacggttgaggccacgatgggctgcatgtagttgtacatgctcaccacagtggggcgcaacagcctctgcgcactcattatgaagatataggcaaggaagcttcctcccacaaccacatatcccgcttgcagcagggcggctgtagatatttcgctccactgtatggcagccacgtcgtggtaagagaacgggatgtagcacatggaggcatagacaaacatccatttgttcagggtgatgggagagtatttttgcgacaaccccttgaatacggtcagataaatggagaagctgatttgggcgagcaggcagagaaggtctccgatgaggctgccattgccggcaccggtggtctggctgctcatgatgagtatgaatgcgcccatagcccctacaaagatgcccagcactttcttgttggtgaccggctctttcagatagattgcagccactatcatggtgacgatgggcagtgtggttgtaacgatggaggcgtctatgggcgaagtcatggagagtccgaagatatagacaccctgattgaataccagcgcgaagagtgcggcgaagaatatcttcagcatgtcccggtggtccacctgctcgcgtttgcagaacaaggagaggagccagaagcaggcggctgcgcctaccatgcggaatgtggttactgacaacgcggaaaactccgctaaggtcgacttgccgataggtgccatcagcccccataagatatttgcggtaagggcgaacagatgcccttgaatgttcttgtccatactcttttgttctttgcgggtgcaaaagaacaactattttctgaaaagagaaaatctttcattatatgatttttctggttcatgggcgtagaaataagagattatcgtgtatatttgcttctaattaaaagcaagaaaccatggaagtacaagccaattacatcaagcgtatcgaaatacacggattgtggcatcggtacgatattgcctgggacctgcgtcctgacgtcaatatactttccggcatcaacggagtggggaagaccactatcctgaaccgttcggtcaactatctggaacagacatcgggtgaagtgaagagtgacgagaagaacggcgtacacgtctacttcgacaaccccgcagccacctttatcccctatgatgtaatccgcagctacgaccgcccccttatcatgggcgactttacggcacgcatggccgatgccaacgtgaagtcggaactggactggcagctctatctgctccagcgccgttatctggactaccaggtgaacatcggcaacaagatgatagaactgctcagcggtgatgaagagcagcgtagcctggctccctccctttccctccccaagcggaagtttcaggatatgattgacgagcttttcagctatacccataagacgatagaccgcaaaagcaacgacatcgttttctatcagaacggtgagcgcctgctgccctacaagctgtcttcgggcgagaagcagatgctggtcatcctgctgaccgtgctggtgcgtgacgatgaccactgcgtactcttcatggacgagccggaagcctccctgcacatcgaatggcagcagaagctcatcggcatgatacgcagcctgaatcccaatgtgcagcttatcctcaccacccattcgcccgccgtcatcatggaaggctggctggatgccgtcaccgaagtcagcgaaatctcctccctaatccctaatccttaatccctgcccaagtgtccacttctttaaaacataaccttacttccgcctatctggatgccgcccgcaagttgtctcccaagagagcacgcaggcgcatagtggcgtatgtggagagctatgacgacatcgctttctggcggacgctgctgtccgagttcgagaatgaggaacgttattttcaagtgatgcttccctcggccacctctctggcaaagggcaagaagatggtgctgatgaatacgttgaacacatcggagctgggccgcagcctgatagcttgtgtagacagcgactacgacttcctgctgcaaggtgccaccaaggtgtcgcataagataaacaagaatccctatatcttccagacttatggctatgccatcgagaacttccactgctttgccgacagtctgcatgaagtctgtgtgcaggccacgctgaacgaccggcatatcctggacttccccgcttttctgaagcgttattctcagattgcctatccgctgtttctgtggaatgtctggttctaccgccagcacgacacacacactttcccgatgtacgacttcaacgcctgcgtgcgtttgcaagagataaacctgcgtcatccttaccgtagtctggacgagatgcaaaagacggtgtcggcaaagctgtccgaactgcaagcccgtttcccccgctacatcgaccgggtggagcagctgggcacggagttggaacgtttgggactgactccggacaatacctatctttatatccaaggacaccatatcatggattgtgtagtgctgaaaatccttatcccggtatgtacggtgctgcgtcgtgaacgcgagcaggagataaagcgcctggcagagcataacgaacagttccgcaacgaactgacggggtatgagaacagtcaggtcaatgtatccgtgatgctgaaaaaaaacagtggctacaagaacctttatctttatcagtggttgaaagaagatatcatggagttccttgagcgggaggagcagtcgcgtagataagattgccgttatgataaacatacgattatggagatattgaagaagatagacgaccttttaatcgggtggggcatatccccttcccgtgccgacatgttcgaccagttcatagcctttgcactgatacttgccgttgcttttctggcggatgccctatgccggaaaatcctgctgaaggtagtggcacaactggtgaagaagaccaaggctacgtgggacgacatcgtattcgaccgtaaagtgatggtgcacctcagccgcatggtggctcccgttatcatctatctgtttgttccattggcatttgtcgaagtcggttcatcggcaatggatttcatccggcgtatctgccttatttacatcatcattactttcctgagtttcgttaactcgttcctgaaggctgtttacagtgtatacagtgagaaggagcaatttcgtgaccgccctttaaaggggatgttgcaaaccatgcaagtcatcctatggctggtgggcggcattgtggtcgtgggcgaactgataggccgcgacccgctttcgctgcttgccggattgggtgcttcggcagccatcctgatgctggtattcaaggattccattatgggctttgtctccggtgtgcagctttcggccaacgacatgctgaaggtgggcgattggattgccatgcccaagtatggcgccgacggcacggtgatagaagtgacactgaacaccgtgaaagtgcgcaactgggacaataccattaccaccatccctccttatctgcttgtcagcgactccttccagaactggcgcggcatgcgcgagagcggtgggcggcgagtgaagcgcagcatcaatatcgacatgaccagcgtccgtttctgtaccccggagatgctggcaaaatatcgcaagatacagctactgaaagattatgtggagcagacggaggaagtgattgaaaagtacaatgtggaaaacggcatcgataactccatcctcgtcaacggacgccgccagaccaatctgggggtgttccgggcgtatctgacggcttatttgaaaagtcttcccgacgtaaatcaggaactgacctgcatggtgcgccaactccagcctaccgaccgcggtatcccgatagaactttatttcttctgtgcgctgaaggattgggtgccctatgaaggggtgcaggcggatgtgttcgaccatgtgctggcaatcatccccgaattcgatttgcaggtattccagtctccgtccggcagagatttccagcgggtactgcctgctgcttccgaagaaaaaggagcttgattccgaccatcaaaaaggcctatatctattgtatttctcatagggagtcattacctttgaaccctatactgaaaggtcagaacatccccatcttttctcccaaaacatccccatgttttggggtattacatccgggtgttttgggtgaaaacatccccatgttttggggcaatacatccgggtgttttaggtattcagtcatatagtgaaaggtattcggtcacggagtctttaccgtaaggtataggctttgtgtatgcaagttgtaggtgtgcctcgcgtcgggcgggaatatctttcgttttttacgaacctaattataaagaaagattggtatgtcaatgaattatgtggtccgcaagaaggtggacaagagtggagacaaggaagtggtgcgctactacgcggcgtcaaaagtgcttcagccggaaccggtgagcaatgacgaactggccaagaggctggcttttgtcagctccctgcaggtgggcgatgcccagtccgtgctggtgcaactgccggatattatagcggactatctggccagtggacgcacggtgaacatcaagggacttggaaacttttttccctccatcaccagcgaaccggtggaacggatagaggactgtacggcagataaagtgcgcatttcgcgtatctgcttcagggcggcaggcagtttcatgcagcgcgtttgccgtcatctggacttgttcagctttcaggttcaggaattgaagaaggagctgaagaagaagtaaacggtacttttagtttctttcttgaaacagcgcgtaccccttgaagccggaaggcattcgaggggcacgctgttgaagaagttgtgtgtttttttatagccttgcgagtgcttcttttttttacttcacccagcttccgttcatccagctgcattctttcctgatgtcctcgaaagagctgtagctcaggttggcgtccaccttgttgcttgtcacggcgatgaagtcggcatgggtgtagatgccttctttgctgctcagctcggaggtgagggtgatgttggtcagcttggaggtgccgttcttcagggcgttttcggtaagggcggtttccacggtcaggggctggcctttgccgcataccttggcgttgtctatttccacttccgtgccggcacgcagacggatgccttgcttgctgccgccgttgccgacgaggatgaggttcttcaatacggggtgggcaacgggagtggcggcgttgttgctgccgttgttgtcgcactccatcaggcagtcgcagtcgtagcccagtgtggatttgtcctcttggtaagccacgaggttggtgcctttgccgttccagccttcggtccagtcgaaggagtcgtcgctacagcttacggctacgaggttgctcacgtttaccgagccgccgaagaactcaaagccgtcgtcggaacctttgtaggcttggcagtggtccacgatggtaccgttgcctacgccgtagaaagagataccgttggcttcgtgctcttcatcgaaggcaaagccggtgtattccaggcgaatgtattgcagcgtgcccgagttgtcggcatcatcgttgccgccgtaaacggcgccgcctatttcagaacttcccttgccgccttcggcattggtgtgggcgcgtccgcagatgtgtatgcctccccatgcgcccggctcttctttttcgctggtcattacgatgggtttgtccggcgtgcctacggcgttgattttaccgccctgcttcacgaggatgtagtctgcgatgtcatcgtagacggcgataatcttcacgccttcctctatgtggagcgtggcaccttcttctacgatgtattcgccgctcagcttgtaggtgtttccggcagccagggtcacgtcggaggtgatggtacctttcagtatcgtaccgttttcgatttcattgccgtttccgttgccgccgttgccgtcattgtcgttgttgtcgtcgctgctgcaagcggtgaggatagacattccggctacaaaggccagagagtagaatttccatttcattgctttcataattcaattgttttagttattatattcaattcatctgtctgtcattcagattgattcttttagagcttgtttgtcaaagagtgttctccgtcccccttcagggggagggcgggggctttataggttgtagcttattcccacctcaaagttcgttcccttgcggtagcgttccacttccatctcctgccccgtggtgggcacatcttgcttgaagatgacatcgcggttcagcaggtcgttcacttgcagcttcaggttgaagtgcttgttcaggctatatccggcgctgaagttcaacgtgtgcagcgtctgttgcctgacatcgcccagacccgacacgcctaccgcatggatgcggctgccttgcaggttgtagagtagggcgaggttgagctgcctgtcttcgccgaagcgtggcgagtaggtgaggtcggcattggcaaggatgggcgatgcgccttgcagcgaacgttccttgttggtgtaggcaccgccttggggcagcttcacgttggtgtacatgtaactgatgttggcgcctaggcgcaggtctttgacgagccgtttgcgcatctccagctccacgccggcagccatgccgttgtcggcattcttgaagctgtgcagcgtggcgccgccttgcaggtcttggatgcgttcgatggggctgtcgaggtatttgaagtagccggtcacggagagcatgtcgccgtccttgccgaagcgttcgtaacgtaggtcgaagttgtagttgtaaccgttctgcaactcttcgttaccgcggatttgtgccgaaccgtaggactcttgatagaggaagggggccatctcgatgaacgagggacgggtgacggtgcgcgaggcagagaagcggatgctgttggtggggttcaccgcatatttcaggttcagggcggggaagaggtcgttcttgtctaaattgcgccgacgggagtaccagtcgccgccgtcgctggcgtagcgcacccattgcttgctcatttcgtagcgcaggccgaggttcaccaagagggcttcggtgggatagaagtcggtcagcaggtaggcggagtagatttcgtttccggcgcggtagctgtctttgggctgcatcacacgctgtaccacgatttgtccgtcggcaatgttctgctggttgaggaagccgtcggtgttgtagatgtcggtgatgacggggttcagtttgttcaggttgtagtagaagcgggtagcgttgtagtcgcggttcttgtccttgtagttgaagccgagcttgaggtggctggtgtcgttccacttccagcgcatggcgaggttggcattccactcttcttcgtccaggctgccgaagtagcgcatggtctcttggcggttcagtttgaagagcctgagactgccgtcgttgtctttgacgtacatcacttgccgtcggtcgggctcttcgctgccggtcttgctgtacgagcctccccaggtcagttgccacctgtcgccctcgccgaagttatggattccgttcagttgatggttttgcagggtgtatatgtgcatgatgttgttgctgccggtcagctcgtgtccttcggcatcagtaccttcgcggcgctggtaggtgtcgatggcgttgcgggcgtagaagaaagtgtagcctatgcggtcgctccggcgcagggtgtagcccaggtagccgagggcggcgagcttcagttcctgcgcaaagctgtcgtaggagaagtcgtcctgcacggtgccggtggcctcgagtgtcttgtagaaggcatcttccatgttttggtagccgttgctggcgctgaaggaggcgagcaggctgagtgtctggttgcctataccgaagttcttgccgaagccgaggttcccgcccagttcgggtaacgaactcttcttgccggcgctgaaggaggtatcgaagatattgcaggtcttcacgtatttgtcaaactccatcaggggcatgccgagggcggctgcgtccactctgggtgtcttcaggagcgagccgctgcggtccatctgatagcggtctttgcctaaggtgttgaacttcccgcccgtgttgaggctcagttggaagaaatcttgcggtatgttttctttggtgctgatgttgatgtgcgcaccgctgtagtcggcaaaggcggctgcgtcatacaccttgctgacggtgatgttctgtacggtggacgaggggaacaggtcgagcggcaccagcttgttgtccgggttgggcgaggcgatgggcagtccgttcagcgtggtggtgctgtagcggtcgcccagtccgcggacgataagttgtccggcgctggcgatggagatgcccgttattttctttactccttcttccacattgccgatgcctttgagggacatctctttggaaccgaggttctcgatggcgagggtcgctttttgccgttccatctgcaaggcgcgttcgccctcaaggttcttcttggcggtgacctgcacttcgcccagggtttgcgtgtccggctccatgtcgaagttcagcacggtttcgccctttatctctacggcatttatcgtcatgtctttgtagccgatgtaacggacggtgagggtataggttccgtttttcagctccagtgtatagttaccatccaaatcggcgacggcgccttgtgccgttccgctcacttgcacggtggctcccgtcagcggttctttggtttgtcggtcggtgattgtccctttgatggttcccgccgtggcagccatgacggaaagtgtgaggaataaaataaggaagaaaatctttcccaagtctaatttcatgctcatctcttttctttgtacgttttttaatccgctacaaagatgaggcaatgacattacaccggtgatacatggcacatacgtttcattttcaaatttattacgattcggttaccgcacattcttccggattgtttgttatccttatatataggctgcttgggacgaaaaaggtttctaatggttgcttattagagttttatggctatttttgtatctcaaaccaatattgataaatatatggctgttcatcgtgacgatagtgaacatttccggcgcctttccattcttggccggataggttggtgggaggctgatttttcttcaaggcagtatctctgctccgaatatgtctgtaagttgttaggcttggaaggggaatacctgagctttgaggatttcggtaaaatgatacgcgaagactatcggacgcgtatcagccgggagttccttgccattcagaatatggaggtctatgaacagacgtttcctatctattctactgaaggagtggtctgggtctactcgcgcgtggggtataaggagcatttgccggatggtacgttgaaggctttcggagtgttgcagcgcgtagagatgccgaaggaggaagctgcgaagcaggctttgcaaagagtgaacaatttgctttatcggcagacctcaatatcccattccttattccgtttcctgaaagacgaggatatcagtgcgggcatttacgacatactgaaagatattctcgatttctttcgcggcgggcgtgtctatatattccaatacgatgagaagtgccggtaccagagctgcacatacgaggtggtggctccgggagtggctcctgagaaagaaatgcttcagggagtccaggctgacagcctgccgtggtggacgtcacagattatggcacaaaagcccgttctgctggaaacgctggggcaactgccggagcacgcttacgccgaatatgaaattctggcgagacagaatataaagtccttgatggtaactccgctggttgccaatgaccaggtgtggggatatatgggcattgatttggtggaccgtacccgaatgtggactaacgaggattaccaatggtttagttcgttggcaaatgtcatcagcatttgcatagagttgcgcaaaacgaaggatgaggctgtgcgtgaacgtactttcctcagcaacttgttccgctatatgcctttggggtatgtgcggatgtccattgtctgtgatgaaaaggacaatccctacgggtattatgtgacagatgcgaattctatctttgccgattttctgggaaaacccgcgtcgacgtttatcggcaagactgcctcgtctttttcaagggaggcggcccccagactggaatatctgcttgagatagtgaacaccgggacacataaggaaatggacatgtgttttgagctcaccaacaagcactgccacgtggtgatatactctccggaaaagaatgaagtggtggcgttattcctcgatacgacagactcggtacagactcatctggctttggaccatagcgaaaaactgttcaagaatatctttgccaatataccggccggggtggaaatctatgacaaagacggattcctggtagacatcaacaataaggatatggagatattcggggttcgtgacaaacaggatgtcattggagtgaacttattcgagaacccgaatgtgtccgcccaattggcagaacgtatacagaccgaggatatggtcgacttccgcctgaattatgctttcgaccggactgaagggtattactccacttccaaacagccgaaggatgtgatacatctttatacgaaagtgagcaaggtgtatgacagtaaaggtaactttaccggctatgccatgattaacatcgacaatacggaacggattgatgccatgagccgtatctgtgatttcgagaatttcttcctgcttatatcggattatgcgaaggtaggttatgccaagctgaacctgctcgaccggaaaggctatgccatcaagcaatggtataagaatatgggagaggacgagaatacccaattggcagatgtcgtgggaatatacagcaagatgtaccccagtgaccgcaggaggatgcttgatttcttcagtaaggcccgtgtgggcgaagccaaacatttccagggagagatgcgcattgagcgtccgggcgaaaagggaaaatggaactgggtacgtaccaatgtggttgtcaatctgttcgaaccggagaacggacaaatagagctgataggcgtcaactatgacattacggaattgaaggagacggaggctatgctgattgaagccaaggagaaggcagaaaccgccgaccgtctgaagagtgccttccttgccaatatgagtcatgagatacgtacgcccctgaatgcgattgtcggtttctccagtctgatgggagagaccggggacatggaggaaaaaaggcagtatatggcgattatcgaagaaaacaatgacctgctgttgcagctgatttccgacatactggatttgtccaagatagaggccgggacatttgactttgtggaaaaagagctggacgtgaacgtactatgtgaggacattgtgcgcttcatgaagatgaaggctaaaccgggtgtggaagttctcttcgaccatcatctgccggaatgccggattgtcagtgaccgtaaccgtttgaatcaggtcatagccaactttgtcaacaatgccatcaagttcaccactgcgggaagtatacgtgtaggatatgataaggtggatgaaactcatttgcgtttttatgtggccgatacgggccttggcattgagccggaaatgcaggctcagatattcgaccgttttataaagctgaatacgtttgtgcatggcaccggcctggggctttctatcagcaagagcattatagagcagttgggtggcacaatcggtgtggacagtgaaccggggaaaggctcatgcttttggtttgtgctgccgattgtatagtatggaaatgtgctaaaatacacactcaccacaaattatgcagattaacacaactcaaagctcttgattatcaggacttctaaagataatttgtgccaatctgcgtaatttgtggtaagtgatgataccctccggttataatccgaatgagaacttatcgatggattgatataccacacttgcaatactcagtaccacaatacccagcgtgcaaatggccaggctggcacgtgtatagttgtcactgcggaatgctgcaatcggctcgtcgctcttgttgatgtacattgcctttacaatcttcagatagtaataaagcgagatgattgtattgataagggcaatgaataccagcagatggaagccgccttcgaaagctgccgcgaagatgaagaacttcgagaagaagcccgcaaacggcgggatgcctgccagagagaacagtgccagtgtcatcaggaacgccaacttcggattagtggtatacagcccgttatagtcttcaagtgtgaacttgcctgcccgcagtgccacaatcgtgataacggtaaatacggcaagattggcaaacatatatatcagcacgtagtataccagcgacgtcataccttgtgcgcttccgctgatgacacccagcatgatgtaacctgcttgcgagatactggagaaagccatcaaccgcttcaggttctgctggcgtagggcgaagaggttggcaattgtgatggaggcgatgataacccagtacagcacttcctgccattgttccaccattggagcgaataccttgatgagaatagccatcagcacgaaagcggcagagcctttagagatgacactcagataggctgtcaccgtgcttggagcaccttcgtaaacgtctgctgtccaaagatggaaaggcaccagtgatattttgaatcccatgccggagaagaagaatacgaatgccataatctgcaacgggtcgccggtgaggcgtgccggtatgtcggcaaagtagagagtgcctaccgtaccgtaaatcaaagataatccgtatagcagcaatccgctggagaacagtgccgtgagaatatatttggcacctgcctcggcagagtggtggcggtatttgtcgaaggcaaccagggctgccatcgggatacttgccgtctccagtccgatgaagaacatcaggaagtgtccggcggaaatcatgaagtacatacccagcagggtggaaagtgtcagaatgtagaactcaccttgtttgatggcagtgtccggacggcgcatccattcgtgggccatcaggaatacaatcagtgtacctatactgagaatggatttcacgatgctctgtatcggctggttgtgatacatgccgccaaaggcatcggccacaggaccggggacgatggtgataagtgtatgtatggtcagcagaacaactggcagcattgtgttcagcaccggtttgccgtcattcttgtgtgcatccggactcatgaagaggtcggcgacaaaaaggatgacgatgaccaatatcagcgaaagctcttctttgagcaggaggaattgggaataatccatatctatttacgattttacgatttacgatttacgattgaaattactcttgggatttacgattttacgatttacgattgaggttactcttgggatttacaagtcatttatcaatcgtaaatcgtcaaatcgtaaataaatcagttattggcagcacgctgtctccaatcatgccgctaatccaccatggtgccataccgagggcggcaacgcatgcgatgaggatgatgaccgctgtacgttcgtcccaggttgcatctctcaaggtgaggtgatgcttgttagtgcaggtgccatagagaatctttcctaccagtcgcaggatatagactgccgtaatcacgatggagctgcatgcaatgaccgtccacacgcggtggaacgtatcgggatgctggaacgaaccggtgaagatggtcatttcggcaatgaaaccgctgagtccgggcagtcccagattggcaagaccggcgattacatagcagacagccagaaaaggcataatcttcatcagaccggagagttcgcggacgtcacgcgtatgggtacgtccgtatatcataccgataagggcgaagaacaaggctgtcatcagtccgtgagagagcatctgcagaacagcacccgtgcaagctgtctggttcatcatcaggatggcgaacaacaccaggccgcaatggctgacggaagagtaggcattgatatacttcaagtcggtttgtacacaagcggagaatgcaccgtataccacggagattccggtaagaatcaggaatatccatcccagttcttgtgcagcttcgggcatcaggtacatggctatgcggaaacatccgtaacctcccagtttcatcaatacaccggcatggagcatggatacggcagtcggtgcggaggcgtgaccgtcggggctccatgtgtggaacgggaacagagcgcccagcacaccgaaaccgaggaaggtgagcgggaaccagatacgttgctgttcgatgggaatattgtgcatctgtgctatttccaataggttcatagaggtggctccggcaccgtagtagatacccaggataccgataagcaggaaggcggagccgcccatcagcatcagtgtcagcttcatggcggagtactccttgcgtcccgacccccatacaccgataagcagatacatgggaatgagggcaacctcgtagaacatgaacatggtgaacaggtctatcgagatgaagaacccgaacacaccgatggagaggaaggtgaaccaaaggaaatattctttagtcagcggttgcagcctccaggaggcgaatgttccggtaaagacaatgatggccgaaagcagcagcatggctaccgaaataccgtctactcctaccgaatagtggatgttgagtgcaggataccagaccatgtcggcacggaacagcatttcatccgtggcaccagcgtggcgtgcattgaggtacatcacggtcaatgctgcagaaagaaccagcagagccgatgcaccggtcaccatcactgcgcgtatttgtgcgatgttgcggctgagccaaagacccagcaacatcagcaaggggatgagtacgaataatgataaaaagttcatctttatatttacgatttaacgatttacgatttacgattgaaaaatctcgggttatagcaatagtagcagtatcagtgccagcgtgcccagcaggaatacaaatgtatattgctggatgcgtccgctttgcaggccgcgtatctcttcactggtagcttcagccccccaggcaaggaagttgaagaaaccgtcgaccacgtggcggtcccaccatgcaatggggtggcagatgcagccgaagatgatgcggtgggtgatgaactggtagacctcgtccagatagaagcggtggtaagctgctgtccacaagcctttgaaacggtgtgccaatgtatcggcaacgggttgccggctacctgcatagatgtaggtggcaatggctatggaaaccaccgctacggcgatacttgtacctgccacactccaatccagatggatgttatatgcttcaccgttggaactgatgaagtgtccgaaaggaatgaaaccggcaactatcgtaaccacagcaaggagcatcaggggcagggtcatcgccagaggactctcgtgggggtgaggcatgtggctgtcgcccccatcgcttgccgacttttgtcccggctcagagccggcccaaaagataccataataaagacggaacatatagaatgctgtcatacctgcaatcactgtcataatccatcccatgatggggctgaactggaagcatgccgtcaggatttcatctttggagaagaatccggagaacggaggaatacctgcaatggcaaggcaggcgatgaggaacgtgatatgtgtaatgggcatatacttccgcagtccgcccatggcagacatctcgttgctgtgtacggcatggatgatgctacccgctccgaggaacagcaatgccttgaacatggcgtgtgtgaacaagtggaacatgcctgccatgtagcccagtcccccttcgtgtgggttggctgatgtacatacacccagcgccaccatcatgaaaccgatttgggagatggtggagaatgccagtacacgcttgatgtcactctgcacacatgccacactggcggcatagaatgccgtgaaggctcctacgtatgccacgatgtgcagcacgctgggagcatattctatgaacaacgggaacatgcgtgccaccagatagacaccagcaaccaccatcgtggcggcatgaatcagtgcactgaccggcgtaggaccttccatggcatcgggcagccagatgtgcaacgggaacatggcactctttccggcaccaccgatgaacatcagtcccaaggcaagcggaatcattgccgcaccgccctttgccagcgccatctcattagggctgaaggtgtatgtaccggcataatacccatagacgaggatacctataaggaatcccaggtcagcaaaacgggtcacgataaaagccttcttcgaagcggcaatagccgccggcttcgtataatagaaaccaatcagcagataggaggacacgcccaccaactcccagaacagatacatctggaagatattcgttgctactaccagtccgagcatggacatggtgaagagcgacaggaaggcgtagtaacgctggaaaccgcgttcgcccttcatgtagccgaaagagtatatgtgtaccagcagcgaaacggtactgatgaccacgagcatcataaccgaaatcgggtcgagtaggatacccatgtcgatactgaggctttctgtgaaaggcagccatttgaagttatagggcattagcgcctcgtacgtaccatcggcaaggcggggagcgctgaagtacattcctgcggtgagataggaaagcactgcgaccacactcagtgccgcagttccgataaggccggcagtgcggtgtgacatccatttacctccaagtcccagagcgaggaaagagaggaaagggagtagaaggattaatattgtatattccatatatactatgtttatcaattattactattcaagaaacatcgcttggcgattcttgctcttaccacttcatctcatccagtttgttcacctggatgctgcggatgttgcggtagatgttaatcatgatggcaatggctacagccgtttcggccgccgagatggcgatggagaataaagagaagaaatatccttccagtcctccggggaataggaaacggttgaatacagcaaagttgatgtccgtggcattcagtatcagctcgatgctgataagtatcgccagcgtgttgcggcgggtgaagaacccgtagatgcctgcgaagaacatgatagccgaaactatcagataatattccatgtgtatcataattcttatcttttacgtgctattaataatccacctacgatacatgccaataacaagatgctgacagcttcgaagggaagcagataaccatacttgtcaccgctcagcatgtggtgaccgatggtcttgatgttgacttccaaaggctccacgtcggtggtggcaatgaacttatgcttcaaagtgatgaatactacgatgatggcaccgcccacggtggcacccagtccggcaaggaacctgctacgctttaacttctcgatgacatcgccttcgccactggtaagcagtatggagaagacgtagagcactacgataccgccggcatagaccataatctgcacggaaccgaggaaggtgtaacccagcagaaagtagatgcctgccgtaccgaaaagcacgaacagcaggtaggtggccgagcgcaccatgcggtgggtcgttaccgtcaagatggaaaatacggtgataaaggccgcaaggaagtagaatactactgtttcaagagttatttccatgttgtttaattacaagttactattaacgaattactttgttgtctcttctttgggagcagcgggtttctttttttcttctacatggctgcccggacggttcagcgtcatgaccagtttcgtgcggtcaaacactgcatgctcaaaatcctggtcgaacgtgatggcatcgtgagggcaggcattcacacagagttggcagaacatgcacgaaccgaggtcgtattcgtacttaaccaatatcttctttttcttgccgtcttccgtttcaaccatctcgccggtcaccttgatagtgtcgttgggacaagccatctggcacaaaccgcaagctacacaccgatgttcatttttatcattatggggcatggtcagcgtgccacggaaacggtcggagagtttcaatgtcgagcggttttccggatattgttcggtagtctttcgtcggcagaatacggtcatggttgtcttcatacccgtcagcagagaagtgacgccgtgtatgagtccgccgatataagagttcttttctttcattacttttgcctttattaaaattatccgcaaggaaatcttgctccggcgctacgccggttagaaatgcaatttaaatactacaattaataccatcaaaatcaagttcaccatagagatgggtaccaggtacttccactccagattcagaatctggtcaatacgcaggcgggggaaggtccactttatccacatcagcaggaagactacgaagaaggcctttccgaagaaccatacaaatcccggaatgtaatccatcactgcgttgaagccgtccaggcctacgatgtgtagcggcatccagcctcccaggaagatggtggctgccacagaggctacgataaacagattcaaatattctgccagatagaagaatccgaagcccataccgctgtattccgtatggtatccggcagtcaactcgctttcggcttcgggcaagtcgaagggaccgcggttggtttccgcatttccggcaatgaggtagatgatgaaggctatcaatgcagggatatgtcccttgaagatgaaccagccgtcagcttgtccttctactatttcggagaactgcatggttcccatcaacactaccattgtcagtatgctcaatccgcaggacaactcgtagctgataatctgcgcaccgcttcgcatggctccaatcagcgagaatttattgttggaactccagcctgccagcaggatacccactacgccgatactcgatgcagccagcaggaagaacactcctacattgaagtccaatacctccaatcccttgttgatgggcaggcaggcaaatgtcaggaaagaagcgatgattaccatgaacggtgccagattgtagaggaaccggtcagagaatttcaaatcaatgatttcctttgtcaacatcttgatgacgtcgcagggcacttggagcaatccccatttccccacgcgcatcggaccgaggcggcattggaagaaggcgcatattttacgctccatgtaaatcagggtgatggcaagcacggcatacatcaagatgatgcatacgccaatcaccacgcattcgaggaatattgccagaccttccggcatcagggaagtcagcatctggtgtatccagttggttactatactaaagtcaaacacgttgttcatttactatttacaatttactatttacaatttacgaggcgctttttgatttacaattcacaatgtacaatttataatttggctgcgctgtaattccgcatggtaaattgtaaattgtcaaatcgtaaatccttttatctgtcaatatctggtactacataatccaatgttccgccaatggcaataaggtcggcgattttagctccgcggcaaatcgtatttacggtcgataccaatggcaagcccgtactgcggaaatgcaggcggtaaggcatcttgtcgccgtggctttcgaggaagacgccgaactcaccgcggctaccttctacggctgcataataagtgccttccggtacgcggataataggtttcatcttttcctggtaggctccttccgggatgttgtctatcagttgctcgataatcttcaggctctccagaatttcatccatacggataaggtagcgtgcccatgaatcgccttcggtgcggatgatttctttaaagtccaccttgtcatatacggcatatggcatacgcttacgcacgtcgcaggcccatccgctggcgcgtccggtgcctccggtagctccaaaggcgatggcatcttcccgtgagagtatacccacacctttcagacgttgctgggcaatgatgttcccggtgaatacgtcgtgatattcgtgtaggataccgcggaggtaggggataaactccttcactttctttacgaagccgggagcaatgtctgcctgcacgccaccgatggtgttgtagttcatgatgaggcgtccgccgcaagtttcctcaaagatgtcgagtatcttttcgcggtcgcggaaaccgtagaagaaggccgttaatgcacccaggtccatagcaagacaagaatagaacagcaggtgagagtctattcgctgcaactcgtccatgatggtacgtatgtactgcacgcgttcgcttacttccacgcccattgccttttcgatacacatgcacaaggcatggcggttctggtgtgcgcccaggtagtccagacggtcggtcagagccaaggtctgcggataggtcaggctttcgcacatcttctcgataccccggtggatgtagccgcagttggcatcaatcttgtcgatgatttcaccctccaatgatacacggaagcgcattacgccgtgggtggccggatgttggggaccgatgttcaccacatattcctcatcaccgaaaagttgcatctccttattcttgatgctaccgtcgggattcagctccaattccatggtggtgtccaccgtttcttcgttgtccatacgcaacggattatctttttccggctcattgtctttacgcatgggatagcctacccagtcattgcgcagatagagtcggcgcatatccggatgaccgatgaaaacgatgccgtaaaagtcgtagacttcgcgctcgttgaaatccgcagctttccagatatcgctgacggaaggaagttcgggatgttcccggtttagagtggcggtgcgtaccgctatccgttcgctggtaatagtagattccaacagatagactacgccgagtccgcggggggtgtccggtgcgtctttctcgtcgggtattccccaatccataccgctgaggcattccaggaagtccatttgtttctctttccgcagacgcagcatttcgtcgtgcaggactgagggctctatgtattttatttccatatttttaagtactgattagtggttctcttcttttctgtttactccaccgaagtatttctctattttcactttacgctgcaattgcatcatgccgtagtagaatgcttccggacgcggagggcaaccgggaatgtagacatccaccggcagaatcttgtccacaccgttcaccacgtgataggatttcttgaacgggcctccgctgacggcacagccgcctacggctactacatatttcggatcggccatctggtcgtaaagacgtttcagaacgggagccatcttgttggttattgttccgcaaaccataatcatgtctgcctggcgcggactggcacgggctacctcgaacccgaagcgcgccatatcgtagcgggctgcgccgagggccatgaattcgataccgcaacagctggttgcaaacgtaagaggccacagtgagttgctgcgtccccagttgacgaaatcgtccagtacgccaagggcgacattggcgcctccggcattaagttcccgaaccagtttctccaacgtttcgttgtctgtaaactcctcataagggatagatttaattttcggtttctttgttacttccattccaaagctcctttcctccaggcataagcaaggcccagaatcaatataatcaggaaaaataaaacactgaaaagtcctgccacgccaagttcgcgggtgatgactgcccaagggaacagaaataccgtttccacttcgaacatcaggaacaagatggcaaacagatagtaacctacccggaattgcatccacgatttaccgcgggtagggataccacactcgtacggctccatcttctgtgcattgtacgaacggggtgctatcgcattggagagcgcgatgacgatacccacgaaagcgattgccgtcaataagacgaccactaacaaagtaaagttcataaacctgataagattttagatatataataatagatacatcgcaccggaggacaaaacctctgatttgttgtccggcgaggtcaggggcaagcgtctgcgcttgcaggccttctaaatgataatctttcttagcccgaacacgtaataattcgcgtcgggtacgggatgaggagacagattcaacaaacggtcgcattccggtgcataggcatgctgctgcatcttgtagatgtacatgcgcaggagtacgcttttgttggttggtacttgcgtatggtccacatgttctatgcagagggagtttggtgaaaacaagtcgtagaacttctggactgcttgttgggtggtaggagcttgtgacagcgtacagcattctgcttgtcgggtggcaggaacgcacaaaatatctgcagctccggttgcactgtcgtgcaatagggctgcaaagattatgattaaacagtatttaatgcattgcttcataccacaattctctctttcaaggacgcaaagatataataagtattgttcaatttgctatccccgcataacaaaaaatgattatttttacactttttatcctaaatcaattccgtttccagaaatccggtgtgaaaagtagcagtacggtaaataactcaagacgacccagaagcattaaaaaggataacagccatttagctgcatcgggcagggcattccacgaataggcaggtccggtttcacccaatccgggtcccatattaccgatactggaaatgacgcagcccattgattcttcagccccgacacccatagccatcatgagcagtgtgccgatgactataatggagatataaataaaacaaaaagccagtacggtggagacaatggagggagagattacctgcttgtttatccgtaccggaagtatggcattggggtgtaggatgtgtttgaactcgtttcgtgagactttggtaagaattaccatacgtatacacttcaagcctccggtggtactgcctgcacacgctcccatcagcatgatgatggtaagcagcccccacaagacgggtgtccattgcatatagtcatctgtcgcaaaaccggtggaggtctggagggagattacctggaacaaggatttgcggaaggattcttccatccccatgggactggtatagtaaagcacgatggctatgacggcagtgaagagcacaactgaaccgaaatagaatttcagctcggcattgccgatgaacttcttgaatttccggttgacgaacaataatagcaaggtgaagttgatgccggagataaacatgaaaatggagatgacatattctatataaggagaattgtagtaggcaacgctggcctgcttggtggagaagccaccggtaccggtagtggcaaatgcatggcagatactgtcgaaccagtccatacctccaagcatcagcagaccgacaagcagagcggttatgccggcatagatactccaaatccatttggcggtgataccgatacggggatgaaccttgtcatgtgtagggccgcttgcctcggcggcgaacacctgcaggccactgactccgaagatgggaagcactgcaatggtgaacatgatgattcccaagccgccaatccactgtgtcatactgcgccagaacagtattccatgaggaagtgactcgatgtcgtccaagatggtggcacccgtactgctgaaaccggacatggtttcgaagaatgcattggcaatgtcgggtatgtatccgcctatatagaaaggtagcattccgaaaagagagaatgccacccaggcaaagctgaccagtacatatccgtcacggcgcgtcagttgtcgttcacctcccttgccgagagccgccagcaataagcctacccctgctgtgatgcctcctgctttccagaagtcgagcatatcgctttctctgtagtagaaggacacgcccgaacagaccagaaacatgactgtttccagcaatagcagaataccgataatccgtatgattgtcttgaagttaatcatttaccaactactcattctcaattagttaaagtatttttcgattttcttaatcatcatgttcaggcagaataccactacatggtcacccggctgtatcagggtgttacccataaccacaacgccttccccctggcggataagtccgccgatggtggctcctttcgggaggccgaggtcttttaccggatgtttggtaatcttcgagccggccttaacggtaaattccgctacatcggcattggcaaaggtcaggcatttcacgttgctgacgtccgcatccagcatcatctggtagatgtggctggcagcaatcatctttttgttgatgacggtgccgatgtcaaggctttcggccatgcctatgtagtcgatgttctccacttccgctacggttttgctgactcccatgcgtttggcggcaaggcaggccaggatattagtctccgagttgccggtcaaggcaacgaaggcttccgtatttttcagtccctcttccacaagcaggtccatatcccgtccgtcgccattgataatcatggtacggtcgtcaagcagctcggtcaggcggttgcagcggttcaggtcgttgtccacgattttcacctgcatgtagtccgggacatattgggcggtgcgtacggcaatccggcttccacccataatcattacgttgcgcacatcggcataatcttccttgccggctattttgcggatgtaggggacgtattttcgtgtggtggtgaagtatacgatgtcatgtagcttgatggtatcgtcaccacggggaatcagtgtttcgcttccccgtttgatggctaccacgtgatagggcagctccggtccgcccaactcatggagggggatgttcagtatctcggctttttcgcgcatcttggtgcctatcagtatcaaggctcctccgcagaattcccaccattggcgtacccagctcatgcggatggaggacacgatttccttggcggcaagcatttccgggtagatgagtgaatcgacgcccagcttctggaaaaattccttgtttttgggcagcaggtattcgtagttgtcaatacgggctacggtcttctgtgctcccagattgttggcaagcatgcatgcggtcatgttccggctttcatcgggggtgacggctatgaacaggtcggcttctcccactcccacttctttcaagccttttatggaggtaggggaagctgtagccgtcatcaagtcaaagttggagttcagtgtgctcaacttctcttcgttgtcgtccatcagaatgatgtcctgcttctcgcgggacagcaacttggccaagtgtgtgcctactgcgccggcacctgcaataattattttcacttttagttcgctgatagttggtaattaatagttgacctatggggtaaatgctcaaactgtcaattttcaactatcaattatcaattgattatagattccttcttcgtccattccgcaaagatggtgcaactcttgtatggtgccgtgttctatgaaggcatcgggtacaccgatacgtctgaaatggggaatatagtcattgtccgccatgaactccagtatggcactgcccattcctccttttttgacaccgtcttctatggtgacgacatgctggaagttgagtcccacctcgtgcagcagggcttcgtcgagcggcttgagaaaacgcaggtcgtagtgggctatggagattcctttgtccttctccgcacgctctatggcacgtgcggccacgttgcctatgggaccgagggtgatgactgccaggtctttgccttctttcagtctgcgccctttgcctacggggatttcttccagcggacatttccaatccagcaatacgccgcgtccgcggggatagcggatgacgaacggaccttggtccggcaactgtgccgtgtacatcaggcggcgcaattcatgttcgtccatcggtgaagatatggtcaggttgggaatcggacggaaataggccaggtcgaaaactccatggtgtgtcggtccgtcttctcctaccagtccggcgcggtctaggcaaagtacgacggggaggcggagcagggcgatgtcatggatgacattatcgtatgcccgctgcatgaaggaggagtagatgttgcagaaaggctgcattccttctttagccataccgcccgagaaagtggctgcatgcccttcggcaatacccacatcgaaggcacggtcgggcatggtgtccatcagcttgttcatagagcagccggtgggcatggcgggggttactccgacgattttcggattttcctttgccagttctaccagcgtttccccaaacacgtcctggaaaagcggaggcaaattgctggtatccgccttgaggcgttctccggtttccggatcgaatttgcccggtgcatgccagatatccggattcttctcggcaggttcgaagccttttcctttcacagtgtgcagatgcagtattttcggtccctgcatatctttgatgtcccgcaggacacgggctatgtttttcacatcgtgtccattgatagggccgaagtagcggatgttcatcccttcaaagatattctgctgctgggcggccattgatttcaggctgttggcgaagcgaatcagcgctttgcggcggtcctcgttcaaaagtcccattttgaacagcagtctggatgtcttgaagcgcagctggttatagcggttgctggtagtcaggttgaaaaggtactgcttcatgccacctacacttctgtctatcgacatgtcattgtcgttgagaatgataagaaggttgttgggggtggacgaagcgttgttcagtccttcgaaagccaggccgccgctcatgcttccatcaccgatgacggcgaccacatggcggtctttctcgcctttttcggcagcggcaacagccatgccaagagcggcggagattgaatttgacgcatgtccgcaggtgaatgtgtcataatcgctttcctctggtgagggaaaaggacgaactcccttgaatttacggttggtggagaatgcttcacggcgtccggtcagtatcttgtgcccgtacgcctgatggcctacatcccagactatgcggtcgtacggagtattgaatacgtagtgcagggcaacggtcagctctaccgtgcccagactggctgcgaaatgtccggggttgcacgaaacctcttttataatgtcttgcctcaattctttacagacttcaggaagctcttctacgctgagttggcgtaaatccttgggaaatgtaatggtgttaagcaagttatatgttgttggttctgttctcatttctaatctgaagattacaaaatgcaaaaatagcaaaagaaaacggatggcgggaagttttagaaggaaaaaaagcctcttttgttcacttctgtttttactttctctttgcatacgccacatttctcgttccgcctgcctatagttaagggaaaagatgcctgatattaaatcgttcctccatggagaaaatattgttccatcctgtagaaaaaatcgttccaccatggtggaacgattttttctacatataggaatgatttagtgttagtagacaaggatattaatccttccaaagattgacttttattctcgcacgtgaccgtctgtgataagagctgctctacacttgatgtttgttgaaaaatgcaattttataaattatttattgcaactttttagaagctttggttgttgttgatataatattatatatattgcgaagtggaatatgtcctgtttatcaatatgttatacaattctgaattgtatgtgatggtattcttggttgtaatatgtgtcggaatggggtgtagtcacgaattgttaaatgaataaacaatgaatgatatgaagaaaaagcttgactttaaagttttggctattatgggcgtagtggttttttccgcttgcggttctgatagcgatctgttcaacccggaaaaggcggcagctaagaaagaggcacagtatgcatcggcttttgtgcagaggtatggagaaattgcagttgatcaggattggggatttggggtaacaccgacaacgcgtgttgctaacactaatagcaatcaatggaaagattttacggaagtaccggggagtgttacggctacagaaaaagaagtggttacggaatggtttaaaacatatcggaatccacaatccattgggggggattggaccgacttttttgttcaacatgtaagtggctcacactctaatatggattttttggttgcggcatcagatgaccatatcaataattttaatgctactgagggggctataatgctaatgcagaatagtggaacgtcttcttttggctatagggcttctctggatggtaaaatgcactataattatactatacaatatattgagggtgcttattatgtgggatttgactttgaagctaccggacagaacccaaatcaacaagtggctgcagatgggtattatagtgattggattgtgaagatctctccggccgtatatacgaatgcgtacagaatcatagcagaagaccttggagacagtgatgattttgacttcaacgatgtcgtgtttgatgtagcgaccaatggaggagcaactatcattaccctgcaggctgcgggtggtactttgcctttgtatattgaggtgggcggtgatagccgtgaagttcatggactctttggcgtttctaatactacaatggtaaatacaggtgctggggcaactaaggctccggtgatgtacagagttgacggtaccggtgccgtaaatatcaaagtggaaggtcaaaatgctgaagtatatacactgaaagcggagataggcaaagcgccgcagaagatacgtgtagagacaagatatgaatggactgctgaacgtcaggatattaatgataaatatccaggttttgcagattgggtggctgatcctacggctaattggtattaatagaatatatagtatttttatttaaggcagatgatataatgaaaggttatatcacctgcctttttatgtttcgaccgttatatattgaaatttactatctttgtggcgtagcaagcagttggtacatcatttttttcgagaaagtgaatggtttatttattccgagcttatgaatctttatacgcctgtagaagtagtttccagtatgccccttctttcgcaagagaataatctgttgctgatgggttcttgttttgcgtccgagatggggcaaaggctggcggatgccaagttccgttgtgacgtcaatccttatggtgtgctttataatccgttttccatttctgcggcattgcgtgaaatcattgcgggcagatgctacaatgaaaacgatattttcctctttcatgaactttggcacagtgccatgcatcatggtagcttttcctcagtctctgcagaggaaacattggcaggtattaacgggcgtttgaaaagcgcccatgaaaggctggaccggttggattgtctgttgctgactttcggctctgcctgggtttatgaaaatgaaaagacgggaactgtagttgccaactgtcataagcaacctgagtcctgctttacccgccgtatgctttctgtcagtgaaatagtatctgactacacctctttgctttccggcttgctggcgcggattccccggttgaaagtattgttcaccgtcagccccatccgccacgtgcgtgacggaatgcatgccaaccagctcagtaaagctaccttgctgcttgccgtgaaccagttgcaagccactttcccggaacatgttttctattttccggcttatgagttgctgctcgacgagcttcgtgactatcgcttctatgcagaagacatggtgcatccttccgaaacggccattcgctatgtctgggaacggtttacccggtcgtgtatctctgccgatgcgttacggattatggaagaaagtgaaaatatccgtaagatgttgtcacataagccattttatcccgcttcagaagagtataagcgttttttaggacaaattgtgttaaaaatagaccaacttaacagaaaatacccgtacttagatttccaaaaagagagagaaatatgtcgtattcgattgaaagcataaccgaaagtattggcgcacggcgtatgggaaacgcgccggctaccatagactggctgctcactgacagccgttccctgaattttcctgaggaaacattattctttgccttgaccaccaagagaaatgacggtgcgcgctatattgcagatttatatgcccgtggagtacgtaattttgtgcttagcgaagaaagctttagattaatggacaatggacaattgacaattgacaatgctatgcagcgtgatgatgcgcagtcaattgtcaattatctcattgttcccaacccgctgaaagccttgcaaaaactggcggaacagcatcggaaccggttccagataccggtcatcggtattacgggaagcaacggtaaaactgttgtgaaggaatggctgcaccagttgctcagtccggaacgtgccattatccgttctccccgcagttataactcccagattggagtgcctttgtctgtgtggcagatgaacgaacagtccgaacttgctatttttgaagccggtatttccgagccgggggaaatgcgtgctttgcagaacatcatcaagcctaccataggtatcctgaccaatataggaggggctcaccaggaaaatttcttctcgttgcaggagaaatgcatggagaagctgacgcttttcaagaattgtgatgtagtgatttataatggtgacgatgagttcgtcagcaactgtgtggcgaagtccatgctgtctgcacgtgagattgcgtggagccggaaagatatggaacgtcctctatatataagtaaggtggagaaacgggatgactgtactgtcatttcctatcgctatctggatatggataatacgtttactctaccgttcatagatgatgcttccatcgagaattcgctgaactgcctggccgcatgcctctatctgatgcttcctgccgaacagattacagaacgtatggcaaggctagaacccatcgccatgcggctggaagtcaaggagggaaaaaacaactgtctgttgattaacgacagttataattctgaccttggctcattggatattgcactcgattttctttaccgccgttcgcaaagtaagggattgaggcggactttggttctttcggatatattggagaccggtcagaacacgccgacactttaccgacaagtggcacagctggtaaacagccgtggcattgaacgcatcataggtgtaggaaatgaaatatcttcctgcgctgcacgctttaatatagagaagaccttttatccggatacagcggccttgatacgtgccattcagcgtggggaacttcgccttgaaaacgaaataattctgattaagggtgcacgtaagttcggttttgactccttgacggaagtattggagaagaaggtgcacgaaaccattctggaggttaatcttggagcgatgattgccaatctgaactattatcgtggcaagctgaagccggaaacaaagatggtctgcatggtgaaagcctccgcttacggtgcaggttcttacgagatagccaagaccttgcaggaacatcatgtcgattatcttgccgtggcggttgccgacgaaggctccgaactccgtaaagcgggcatcactgcgaacatcattatcatgaatcctgagatgactgctttcaagaccatgtttgattacaagctggaacccgaagtatatagcttccatctgctggacgctttgattaaagaagcggaaaaggaaggtatcacaaacttccccatccacataaagctggataccggtatgcaccgcctggggtttgctccggaggacatgccccggctgatagagcggctgaagggacagaatgccgtgattgcccgttccgtcttctcgcatttggtagggagcgattcgcaacaattcgacagttttacacgccggcagatagaaatgttcgagaaagcgtccatggaattgcaggaggcttttccgcataagatacttcgccatatctgcaattccgcaggtatcgagcgtttccccggggcgcaattcgatatggtgcgcctgggtatcggcctctatggtgtcaatcccatagacaattccattatgaataatgtgagcacgttgaagactaccatcctccagatacgtgatgttcccgaagaggatacggtggggtatagccggaaagggcatctcacccgtccgtcgcgtatagcggctcttcccatcggttacgccgacggcttgaaccgccatcttggaaatggacatgcttattgtcttgtaaacggccaacgggcagcctatgtagggaatatctgcatggatgtctgtatgattgacgtaacggacatcgattgcaaggagggtgacagtgtggaaatttttggtgaccatctgcctataaccgttctttccgatgtactcgaaactattccttatgaggtgttgacaagcgtttctacgcgggtaaaacgtatttattatcaagactgaagatagggggcagggattagggattagggattgcgataaaattaatccttaatccttaatccctaatccttaattttcctatctttgcactataattaatcagatataactatgacaaacttacttttattaggctttctgcccagcggttccgaatggataattattgcattggtcatcttactgttgtttggtggtaagaaaattcccgaattgatgcgtggtttgggcaaaggagtgaagagcttcaaggatggcgtgaatgaagccaaagaagagataaacaaggctcaggaagatttggataaaccggctgaaaagaaataaaggaacaagggtatttactatttgacaatttactatttactatttgatactctgagaagttcaggagtatgggtaggcttgttgccttttccacagcgcagcccaaatagtaaattgtcaaatagtaaatccccacagcgcagcccaaatagtaaatagtaaattgtcaaatagtaaatccctttatgtcagaaaaagaactaaccttttgggaccacttggacgagttgcgccgggtgttgtttcgtgtactcggtgtgtggtttgtattggctatcggttattttattgccatgccttatctgtttgacaatgtgatattggctccttgccataacgacttcattttctatgacttgctgcgctggatagggcagagactggacttgcaggatgaattctttacccaggagtttcatgtgaagctcgtcaatatcaatcttgccgcaccgttctttgtccacatgtctaccgctttctggatgtcggtggtaacggctgctccttatattttctatgaaatctggcgctttgtaagccctgcactctatccaaacgagcgtaaaggggtgaggaaagcgctgggtataggtacggtgatgttcttcatcggtgtgttgctggggtattttatggtctatccgctgacattgcgtttcctttccacttatcaattgagcgcagccatcgagaatcaaatttccctgaactcgtacatcgacaatttcatgatgctggtgctttgcatgggactggcattcgaactgccgctggtgacatggctgctttccctgctgggactggtgcacaagacctttttgcggaaataccgccgtcatgctgttgtcatcattgttattgcctcggccatcattactccgaccggtgacccgtttaccttgacagtagtggcggtgccgctttatctgctctatgagttgagtatcctgatgataaaggataaaaagactgatgatgaagcggaagaagtggagacagaggaatgatggattgtgaagtaaaggaatattttagtatattgctggaagcctgccacgttgaggaaatctccttggacgtggcctatcggcaattgcgcgagttgctggagcgtttgtgccgtacacagatgcccgacggcagcttgcagatgacggacctttctgcacgtatcagtttcgtggcttcgaaggccggactttccaccgtggaacagaaccgtctgcataccttccggctgacctccaatgctattctgaaccgccaggcggaaccgcaacgtgaacagttgttgcgtgatgccaagacactggcattctttgtcaagcgcttgacgggggaggagatacctgccgaactttatcgcctgctaccccgtgcggatgccacctatatagtggcgccgcccgccaaagaacggataaagcgcacgcgcgtctgttttcagtatgccgatgatacttatttatatgtactgcccgtagacactgtagccgatgagccgttgcgtgtccgttataatgtacctcagattaatgaagagtttgcagaaacttgccggattctgtggcggcatgcccaggtcaatctgctggatgttacggtggacgaagtcggcatactcaccccttcctttattatacttgagcccgattacttgatagacatcagttcgcttgccgaatgcttcaaggattacgggcatcatcctgccaactatatcctggcacggctccagtcgccagacaatacccgtccgttactgttgggtaatattgccaacctctttctggacgaatggattcatgccaaggaggcacccgattatttggcatgcatgaagaaggccttccgttcttatcccatcgagctggcagcatgtgccgacctgcgcgaccgggagaaggaagccgaattcttttccgattgcaagcgccatttcgacaatatccaccggacggtgacagaaacattccgtgcatccggctatgagctcgataggactgatgccgtgctggaaccctcttacatctgtgaagcattgggtttgcaagggcgtctggactacatgcagcgggatatgacctcgttcattgaaatgaagtccggtaaggcggacgagtattccatccgtggtaaggtggagcctaaagaaaacaataaggtacagatgttgctctatcaggctgtgttggagtattctatgggaatggaccatcgacgtgtaaaggcctacctgctctatacccgttatccgttgctttatccggcgcgtccttcgtgggcaatggtgcgccgtgtgatggatgtgcgtaaccggattgtagccaatgaatatggcatccagttacggaatagcccacagtatacggcagagcgcttgaaagacatccatcctgataccttgaatgagcgcggtttggacaataccttgtggaaacgcttcctttgcccctccatcgatgccgtagcgcaacgcatccgttcgctttcgtcgttggaacaaagctatttttatacgctctataactttataaccaaggaactctatacctccaaatctggagatgtggattatgaaggacgtaccggtgctgccgccctctggctttccacactggctgagaaatgtgaggcaggtgaaattctgtacgatttggctatttgcgagaatcatgcggcagatgcgcataaaccgtatttgtcactcagaacgaagcaaatggttgcttcccggcaggagcgggttctgcccaatttccgtcagggtgatgcggtggttctttacgaacggaatacggataccgacaacgttaccaacaagatggtgtttaaaggtaatatagagcgcatatccgataacgaggtctgtatccgtcttcgtgccactcagcagaatgcgggtgtattgcctgctgctagcctttatgccatagagcacgactatatggacacctcctttcgtagcatgtatctgggactttccgctttcctttctgccactcaaagacggcgtgatttgttgttggggcagcgccctcccgagttcgatgcttctttggatactggtattgcgaccgctccggatgatttttcgcggattattctaaaagcgcaggctgcccgcgactatttccttttaatcggtccgccgggtaccggcaagacctctcgcgcgctgcggggcatggtagaagccttttaccgggaggggaaacagattctactgctttcgtataccaatcgtgctgtagatgaaatcagtaaggcgctggcttccattgagcctgaaatagactttatccgtttaggcagtgagttgtcttgcgatgactcattccgcccgtatctgattgagaatgtgttggaaccttgtgccactcggcggcaggtgcaggagcgcattgcccgttgccgtgtttttgtcggtacggttgccacgctttcttccaagaccgaacttttccggttgaagacttttgatgtagcgattgtggatgaggctacccaaattttggaaccacaactgctggggttactctgtacccgcaatcccgcaggcgcggatgccatcggcaaatttattttgataggtgaccataagcagctacccgcagtggtcttgcagtcgtccgagcagtcggaagtgtgtgacgaagctttgcaggctatcggattgtataatttgaaagattcccttttcgaacgcctttataggaatctctccaaggaaagtgccaatcgccaggcatcaacctctcattcttcatcttttatccctcatccctcctacgacatgctctgccgtcagggtcgtatgaatatcgaggtagctttgtttcctaaccgggctttttacggtggtctgttggaaccggttggtctgccgcaccagcagggagagctgactcttgctcctgagctgtgtgattgtgagtttgccggcttgctgactcgtcgtgtcgcttttctgcctgccgcagtcgaaccgccggcacagtcggccaagatgaaccattcggaggcgcggattgtggcacggttggcagcggctatctatcggcagtatgcagctgtttccggtttcaacccggctgtcactttaggtgtcatcactccttatcgcagtcagatagccttgattaagaaagagattgctgctttgggtattgctcctttggaggatatattggtagacaccgtggaacgcttccaaggtagcgaacgggatgttattatctactctttctgtgtgaaccgggcttatcagttgaagtttctggtaaatatgacagaggaaaacggtactcggattgaccggaaattgaatgtagcccttactcgtgcccgcaagcagatgtttatgacaggagtgccgcaactattgaaacttaatcctatttatgccgagctcttgtctgtagtttgccattcgtaaccgtcttatttagtaaatcttaaatattttctgcttctttatagagtttattaataacgctgtgtgagataaaccattatctttgcatcacgtttttttcatagagatttagatttaaggttagaagaattgtggaagtcgtgagacttccctttttttcatcttaaattgtgttccatttacagttttttgtttttgactgtaattgaacgaagaaaagccatttcgtgagaaaaggctttttttgtgcggagtttgcaaggcatgtaatgcagtttgcaaactccgcatgattctgaatatctataaagagacttctgattagtccactataatcggtttgtacttcggaaccagtgccttcatgatgcaccagcctatcaggtaggacactgcacatacacagaagatgatgaaatatccggcaggcttgccctggaatccaagaaataccatttgtgtcttgtcggcatagtcgaacagcaaaccggaactcatgttgatgaggaatgagctgataccgcccgccatacctccgattcccacaatggtggcaatggtgctcttgggaaacatatcacctaccacagaatagatgttggccgaccaggactgatgggcagcgcctgcaatacctatgatgataatcgggaaccaataggcttgttcgccaaatacttccttgttgcccaatggctgtgcaaacaatgccaatagcgggaacagtgcaaagatgaacatggcctgcatgcgtgcggcgtaggggttcttaccggttttgttgataatgatagtgggcaatttcccgccatagacggacaacatcgtgatggcatagagcacaaagataagcatctgtgccgtgggagtatctgaggagaatccgtaaacgtccgaaatgtatgcgggtgcccagaagaggaagaaccaccatacaccgtcagtcatgaatttgccgaaaaatacagcccaggtttgcggatatttgaaacattgcaggaaagaaatgctcttttcatccttggttgtcggagtagtcgcctttttatcctcctcattgtctttgtcttgttctatatatgccagctcagctgcgtttacgtgtggattttcatcaggtttcttgtacatgaatatccacagtcccatccagatgaaacccaatccgccgataacgataaaagccatttcccagccgttgcccacgcccatgcgttggaagtagcgggccagggtggggatacacaatggggctatcagtgctccgatggtagagccggcattgaatatggaagtggagaaggcacggtctttctttggaaaatattcggcagtcaccttgatggcggcaggaaagtttcctgcttcaccgatgcccagtatgatacgggcggcaatgaagtagtaaacgctggtgatggctatggtagaggccaatgcaccggtagcgctaatcatgttggcggcattttcaatgccgagggtcatttctgtggcaagtccgcagagggcgtgcatacaagcgccgatagaccatacggcaatggcccataaatacccttttttcgttcccatccagtcgatgaaacgtccggcaaacagattgcctaaggcatagacaatggaaaagatagctgtgatgtagccgtagtgtgtatcggtccagtggaattcgggggagatgaaatctttccaggtcaatgaaagaacctggcggtcgaggtagttgacggttgtcgcgaagaatagcatggcgcagataatccaacggtaattggtcatccgccctgcggtgttttgaaatgtactcatgataatagatttatattttgatgcaaatgtaggggtttgtgtgttgttcgaggtgtaatattgagtaaaaaggatgtagaaaatgacaaaaataggcatggattatttaagtccatgcctatcggacgttgcagggcaactttatttcatatcgatgtatttgatttcgtctttgtcgctgtatttcaggttttcaccgcccataccccagatgaaagtatagttgctggttccggcagcagcgtggatggaccattcgggagaagtgatggcttgttcgttgtgcagccatatcaaacgttcttcctgcggttcgcccatcaggtgacagatagcgttgccgggtttcaggttgaagtagtagtaagcttccatgcggcgagtgtgcgtgtgggcaggcatggtattccatacagagccgggagccagttccgtgagtcccatctgcaactggttggtaccgccgtctttcactctttccagtacatctttcacaatcagctggtttacgatacggtcgttgctgtcttccatttttccataatggtcggagatgcccagtgcatatttcttggggttggctttctgaagcttggcatcggtggtaatcagctgagtaacatagggcttgtaggccggagccgagttgatgtagaacttggcgggattggtagcgtcgttgctcttgaaagttacttccttatttccgcagcctacgtaaagggcttccttatacttcatggggtattccttaccgtctacagtaaccactccgtcaccgccggtattgatgacacccagttcgcggcgttcgaggaagtaagtgatttccggacccagttcacggaacacttccaacttcaatgtcttgttcaccggcatggcgccaccgtaaatcaatcggtcgtagagggtgtaggttacgttgatttcatccggagccatcactttgtccatcatgaatctgctgcgtagaagttccgtgtcataatgcttcacgtcctgcggatggcaggcggtctgcactttgtaattcacttgggcattggctgccatggcaactgctcccatcataaatgcaagtactaactttttcataatttgttactatttaatttttaacttttaatttttgattgatttctggtatttgataatggcacgacggttcataatcatcaggaacaatgtgcataatacaaggataccggagcctatccatttcaacgagtaggtcaggtggaaaatgacccaagcaaaggggctggatgcaaagtccagtgcaccgccttcaaagccggcggggatattcacggcagcatcttgtgtcttctcgtatacatcgtgggctgcttgtgtgaaatagggggcgaggtctgttacgaaataaagaccgatggtcagtacaacgagtccgatgatgaacgtctttactacatttcctttcgtgatgggcagtaccagcgggaagaggtagaacattccggccagcgacgccagaggcaggaactggttacccggcaggatgacagccagcagtatggttacgggaatcagcagcagggaaaccaccagcgttgcaggatggccgataaccaatgcggggctcataccgatgttcaggccgacagcacctttgaattttttggcaatcagctcgcgggtagcatcggaaatgggcttcaagccttcgatgaacaaagcggtgatacgcggaatcagctccattacggcgcccatcttgatacccaaacctaatatataaggtatcttgtctaccagttcctgaccgttcttgcaagacaaagcaccgataccgcaaccgaccagaatacccaggaacagaggctcacccagcaagccgaatttcttcttcatgccttccgcatcaatgttcaatttgtcaaaaccggggattttgtccaatgctttattgatgactacggcaaatggaacgaaacctgcgcagaaaggctggggaatggagataccctccatcttgtcgtagaatccctggaatttgtcggcggtatagtcggccataatcagggtaatgatgtagcagataatagcggcgaagaaaccccaccagatattgtcgctggcaaaataaacgactgcgccgataaatgcgaaatgccagtagttccaaaggtcgatattgaccgtacgggtcgttttcgttaataacatcagaagatttactcccaaacataccggaatgatgaatgcacccaccgatgtgttataggctacagccgcagctgcaggccatcccatatcgaatactttcaactgaagaccgtaaatttcaacgacttggctcagagcaggaccgaggctgctggtcaacagcgcagtgacaactgacagacctacgaaaccgacacctaccagcagaccactctttagcgccttactgaatttgatgccgatgcatactcccaaaattgtaaagattataggcatcatcactgctgctcctaagccgatgatatagccgaaaacttgttccattctcttgtgatttaattaggtaattgagtttgtttttgcaatagtatgaattaaaaaccgggtcaaaaataagaccttttctcaattaatcaaactcgaaaagcataattatttagtaaatgggacaattttggacgaaattggtcgttatcgtgcacaaaattgctcgttttcgtacacgaaaaccaaataatacactctctgcattgaaaagtatacataggaaaaacaacaattttgggtggagtgaactttaatccagtttactgtgttattataagacattgaaacaaaccggactataatgatatatttgatttttttattggcaataggactattggtcggatggagcttatggaaagctccatccgatattgatttatgggggaaaagatttagaggattgatagttatattggttatattctgaaaatttaactatattagcgcccgaaaagcataaatatggcgctaaatctgataaaaaaggataaatcccactctgttgtaagcattaagctggatgagcaagagtttcataatatttttaaggaatattatgcggcgctttgttctttcgcgttccaatacatggaggatgcggatatgtcagcagatatagtacaagacgtatttgccaagttgtggcagataagagacgatttcttttatcttcatcaggtgaaagcttttctttatacggccgtacgtaaccatgccttgaacgaacttgagcattcgaaggtagctcatgaatacgagcaaaagattatagccaaaaaagcagatgctttttttcgtgatgcgattgtggaagaagagactttccggattctgtcagaagctatagagaaacttcctacccaaatgagagccatcatgcagttggctttggaaggcaaaaagaatgcagaaatagcagagcgtctcaatgtctcttccgaaacggtacatactcttaaaaaagtggcttataaaaagcttcgtgcattccttaccgattattattattgccttctgttatttatctaaaagcacatttttttctattttttcaaaaaaaagtctttatcgattcaccatgtttttattttggcttgtattatcattaaagatagactaaaacatgccaaattatgataaaagagtactttcatatagctcatcttatttccaggcacctatccggtgaagtaacaccggaagaaagccgttttttggataaatggcgcaaagagagcaaaagccatgagcagcttttccaaaagatttgtagtgatgaacattatgcacagcacgaaattcgtaaaatggagtttgattcgcaagctggatggaaaggtgtcgaaacacgtatcaagaggatggagctcagaaggagacatttgaaactgttacggtacgttgctctttttattgcaccagtgctgatattggtttttgcacttcaggatatttctgtaccccatgtcatggatggcaatcaattattggctgcccagcaaatactgccgggtggagccaaagctattcttacattggataatggggaaacggtttatctggatgagaatgccgatgggcggcagttgcagttggctggtaaacaaatacagatagattcaacgaccttgaactacagcgctgcagacgggcaggttgtgcagtcagctttggtatacaataaagttgaagtgcctcaaggcggtgagtatacacttgttctgaatgatggtacaaaagtacatctgaattcaatgagcagtctacgttttccgcttactttcgaagctgggaagcgggaagtggaattggcgggagaagcttattttgaagtaaataagaccggtcatcccttcactgtatcgactcaaggtatgcagattgaggtgttgggaacaactttcaatatttcggcctatccgggtgaagaatatcaggcgactcttgtcagtggttctgttaaggtggacaccggggagggacagagtcttgtcttaaaaccttcacagcaggcatcattaattcccgggagcgggaatatacaagtgcgtacagtagatactgccttctatacatcatgggtgaagggaaaaatcaattttaaagatcaacggctggaagatattatgagaatcctttcaaggtggtataatattgaagtggactattcagacgaagctttaaagaacctgcgtttcggttgctatgtgaaccgttatgaggaaatagctcctttccttgagctactggaagcgacggaaaacatacatgtcaaaatcaacggtaaaactattatattctataaataaccatttaataatttaattatgactaaggaacagagctacaccaggttttgggaaggtagtaaacgtatgtggattacattcctgtttttcagttttattatgattggctttgtgcaggccgccaatacggcgtttgcccagacaacagttactgtaaatgtgcaggacgccactttaagtgacgtgttatgggaaattcaacgccagacggattttactttcatttatagtacaaatgacgtaaagaatgtcaaggtacgtaatttgagggtcacgaatggaaaaatcgcagcagtgctggatgaatgtcttaagaatagcggattggcttatgtcgtaaaagacggggccattgctatccgtccagccaatgaagtgaatgctgtgaaggcagtagaacaagctaatgttatttccggaacagtggtggatgagaccggtgagcccgtcattggagccaatgttttggtcaaaggtactacaaacggccagattaccgatttgaatggaggtttctctatcaaggtggagcatgcatcggctaccttgcttgtctcttatgttggctatgttcgtcaggaagtgaaagctacttcgggtaagatattgaagattgtattggtgccggatgcaaatatgatggaagaggtggttgtaaccggttacggtacattcaagaaatctgcttatgcgggttcggctgccagtgtgaagaatgaaaagattgccgatgtgccttccgtttctttccaggatttgttgcagggaaatgctacgggtgtacagtttacttctgcttctggccagccgggttcttcagcttctttgagtattcgtggtatgggctctttcaatgcctccaactctccgctgtatgttattgatggagtgcccgttacttccggttcgataaactccatcagttcggatggtggtctggatgccatgtcaaccgtcaacacttcggatattgagaatattacgattatcaaggatgccgctgctgcatcactctacggttcgcgcgctgcgaatggtgtggttctgattacgacgaagaaaggtaaaaccggtaaggcttctatcagtttgaaagccgattggggattcagtgactttgctatggattatcgtcctactttgagcggagcagaacgtcgcgaatacatatacaatggtatggtgcttggacaacagcgcagcggcaaatcggatgcggatgccatagcttatgctgataagaatatcgacaaatatgctccggttccctggtgcggctatacggattggggagattatctgttcaagaaaggaagccattccagttatgaggcttccatatccggaggaaccgacaaattcaaatactattcttcattgtcctatctcaaccaagaaggtattgtaaaaacatcggggctggaaagaattaccggacgtttgaatgttgattttcaggctacggataaattgaaattcggtgccaacatcatgtttaccaatctgaatcaggatgtatatagtgaaggaaccggttatactgctcctttctactccagcgtaagcaaattgacgccttcagatccggtttacaatgaagatggaagctataaccaggacttgatttcgttgtcaagaagaaatcccgttcttgcccaggagtacaattaccagcgtgagtatgttacccgtatgttcaatacgattaatgccgaatatgaatttatcaaggacttgaagttgaagtctattttgagctatgactataacatcagtaagggtaaagaatggaaagactcccgtacctccgacggtgagaagaataatggtggagccgaaaaggcatatagtgaatataacaagttggtgtggtcaaaccagttgacttacaagactactatccaaaaggaccacaatttggatgcccttgtcggatatgaaatcgattccaagtacaatgatttcttgtcgggatatgctactaacttcctgactccgataaagaatgacattgccaacgggcagactttggagagcatagatggttcttccaagaggtcaagaatggtttcttacatcacccgtctcaactatgactacaagaacaagtattatctgggtgggagctatcgtatggatggcagttcacgtttgcacagagataatcgctggggaagtttctggtctgtttcaggagcatggcgtattatcgaagaggatttcatgaaacccacgtccaaatggctgaccgatttgaaactccgtgcatcctacggtgtgaatggtacgttgccctccgacttatacggctatatgggcttgacgagccttagtggcggctatatggagaatcccgcattgattcagtcgcagattgaaaatagggatttggaatgggaaacgaattacaacttgaatatcggtctggacttcggcttcttcaaccgtttgaacttcactttggagtactatacccgtaccactaagaaccttttgatggactgtcccgtatctatgactaccggtttcagttcctatctgatgaatatcggtgaggtgaagaaccagggtgtggaattggaaatcaattccaagaacattgtgtccaaagactttgactggtctacctctttcaccctttcgcacaacaagaataagattgtgaaactggacggcgaacagacccagattatcagcggctcgcagattcacatgattggcaagtcctaccgtacattctacatgatagaatttgccggaatcaaccccgagaccggtgcacctcagttctataccaacgacgtggacgagaatggaaactatattaaggaaatcacagagaataacaaggatgccaaagccattcctctgaagaaacatgccgagcccaatgtgaccggtggtctctctaatactttgcgttacaagtggttcgatttgagcttcatgttctcttatcagttcggtgcttatggatatgataactgggcacagaaaacagaacatggcggcaaggactttactcttaatattccggcctattatcgtgacaattggaagcaaccgggagatatcagtaaatatgaagtgtttatagagaagccggcggtagccatgaatggcgttaccactacccgccgcttgcacagcacggactttatccgtctgaaaacgttgactttcggtgtgaccgttcctaaaacatggacccggaaaatcggcgtaaacagcctgcgcctttacgcatctgccaacaacttgtggacttgggcggcttacgatttctatgatccggaatcagtcagtgcaggtacagccggctggggaacacctcctttgaaaacagtaactttcggtcttaatttgaatttctaacctcataataaagaaacacaatgaaagcattaaaatatatgatgatggggatgttggtcagcctgaccgcctcctgtggcaatgactggcttgatgttgaatccagtacaaagattccgactgaaaccgccatacagaatctggatgatgtggaatatagcttgaacggtatctacgacgtgatgcgcagtaccaactattactcgggccgtatgatttattacggagacgtgacgggtgacgatacgcagtccataaagaccggaaagcgtaccaccagctactatatgctggactatacaaaggattccggtccgtcttcccactggtcttatgcctataagattatccagaattgtaatatcattttgtctcaaatagacggattggatgtcagtgaggatgatacggaatacttcaacgacctgaaaggccagaccttggctctccgtggatttgccttgttcgacctgacccgtttcttcggctatccgtatgccaaggatggaggagcttctttgggagtgcctattgtgaccgaagtatccaatacggaaaacaagccgtcgcgcaataccgttgcccagtgttatgaggcaatcatcaaggatttgaaggaaggtgctgacctgctggatgaagaattcaacaagggtaagattaataagtgggcggcaatgctgttgctgagtagagcctatttgtatatggaagataatcagaatgccttgattacggctgaagctgccattgcgggagcggaaaagaataagtaccgtttgtggaccaatgatgagtatggcacgatatggggaactgattttgcctcttccgatccgggagaagtcttgtttgagttggtgaatctgacagtggacggcgttggcaaagaaagtgtggcttacctttgctggcaggcgggttatgatgattattgcctgaccagttctttctatgaactgatgcaggaagatccggatgatgtcagaaatcaggcatatacggttgttcctaagacaaagagagcttacatagccaagtatcagccgcagagcggcaaggctgtggaagattccaatattccagtacttcgtctgtccgaactttatctgattgctgccgaagcggctgtaaagctcaataacaatgacaaggctgtaaagtatctagatgctattgtcagccgtgccaatccggaaaagaccgtgcagggtaagacggtgacgttggatgatgttctgttggaacgccgtaaagagttgttcggtgaaggacaccgtttcttcgacgcccttcgtaatcatcagactatcgtgcgcaaggagtcgaccaaggaattcccggaaatagccgagacttcacatctgaagatggtggatgagagcgtatcttttgattggaactattatcgtgtagtattgcccattcctaaggcagagatgaattccaatccgaatatgcagcagaatccgacttatggtgattaattccaaaaaagcgagaatatgaagtatcagactactattgtaaagtctttttttactgtatttattctaaccttcatcagttccggcctaagtgccggaactcttggtttagacggtaagaagaaggataaggagaagaaggaggaattgtcggcagacggaccttatgtgatttatgaaccggacggaaaggtgcgcgtcataagcgttacagcccaagggcagatagaagatacgacttatacagtacttcctcaggatttcacccttcatgtcacggaccacaaagggcgttatccgtttgatgtgaagctgcatccggtcaaacgtccggaatggcaatacagacaaccggataaagtgtttgtgatgtctgacccccatggcaagctgaattgcgtgatgagcttgctgcggggcaacaatgtcattgataaagactaccattggagttttggaaccaaccatctggtggttatcggtgatatatttgaccgtggcaaagatgtgccgcagatattttggctgttctataaattggagaaggaggcggcggatgcaggtggtcatgtctcgtttctgttgggtaaccatgaaccgcttgtgacggcaaatgatttgcgttataccaaagaaaagtacaagacattggcccgaaaactgggtatggattatccggcattgttcggtccggacacagaacttggcaaatggcttggtacccgtaatacgatgcagaccatcggacctaatctgtatgtgcatgcaggtttgggaaaggagttttatgacagtgacttgaatattcccacagtgaatgaggaaatgagccgtgcattgttcatgagcaagaaggaacgtaaggctctatcgcctctcacggctttcctatatggtaatagcggccctatctggtatcgtggattggtacggacggatgcaaaataccatccattggcacaagactccctgcaactgatgttgaaacgttatgacgtcgaacatatcattgtggggcatactatctttaaggatatttccactttctatgatggacgggtgattggagtgaatgtggataacgaggaaaaccgaaagaagaaacgtgggcgcgctttactgattgacgggaatacctatcttgtggtgggagataaaggaacgatgcggaaattgttctgaggctgttctctttctgattattttttaggcgtggaagtacgtggatttcacggagagacaaagaaaaactccgcgtttttcgcgtaatccgcgcctaaaaaatatcataatgtaaatatgcgctctcggatagccgggggagggagtgccctctcaaagatcggcgataacggcaatgtccgtagcattgtctacgatatgtgccggatgaaactcttccagttctgtgcggggacggaatccccaggtgactccgcaggcagtgactccggcattggcggccgtctgcatatccactccggagtctcccacatatagcacgtcttcacgggatatccgggtgatgtccagaatgtcatgcaccactgtcgggtcgggcttcacgttgaccccttcccgttgtccgaagacggcggtaaaacgtatgtgggggaaatagtgtgaaatcagtttcacggtagccgattgatatttgttggaagccactgccaatatcatccctttctcctgcaactgttccagcagttcggggatgccggggtaagggcggcttttatcagcattgtgcacgtcataataaggcacaaactccttgcggatgcgcaggacgttttcttcgctcttttcccctttcgggagggcgcgctcgaacagtttgttgattccgttgccaaccatgaagttatagtccgattccgggtgagtgggatagccgagcgcttgcagggcatggtttgtactttgtgccaaatcggctattgtattcagtaaagttccgtccaggtcaaatataatcaacttcttcattgctttctctattttttagtttgctgcaaatatagggctttttgcgctcatgttcaaatgctgtctcgggtttcatcaggtatttgcagaataggaagccctggactgataatcagtgcattattactgcattcctgctgcatgctttttgcagtagtactgcaaatagggtgcagcgttactgcatatatgtttgcagtgatactgcaactgtattgcagtggcactgcacaagcgttgcagtagttttgcagtgggtgatcggtgtattttttgccgttcttcccttttctttgcacactttcgggctttttatgcaaaaacttcctatctttgcagccgaattttactaaaaataggtatgagttacaatttgttgaaaggaaaaagaggcattattttcggtgctctgaatgagcagtccattgcctggaaagtagcagaaaaagcagtagaagaaggtgcagccatcactttgtcgaatacgccggttgccgtccgtatgggcgaagtgtccgctctttcggagaaactgaactgcgaggtgattcccgcagatgctacaagtgtagaagatttggaaaatgtattcaaacgctctatggaagtattgggtggcccggttgacttcgtgctgcactccattggcatgtctcccaatgtgcgtaagaaacgtacatatgatgatttggattacgatatgttggaaaagacgctggatatttccgctgtctctttccacaagatgatacaagctgccaagaagctcaacgccattgccgactacggttcaatcctggctctgagttatgtggctgcgcaacgtacgttctacggttacaacgatatggcagatgccaaggcactgctggaatccatcgcccgcagtttcggttacatctacggacgcgaacaccatgtacgtgtcaacaccatttcccagtctcctacgatgaccactgccggttccggtgtgaagggtatggacaagctgttcgacttcgccaaccgcatgtctcctctgggcaatgcttctgccgacgagtgtgcagactactgtatcgtgatgttttccgacctcacccgcaaggtcactatgcagaacttgttccacgatggaggtttctccagcgtaggtatgagccttcgcgccatggctacttacgagaagggactggatgagtataaggacgaaaacggaaatatcatttacggctaatggaactcgcactttatcttctgccggtcaccttgggcgatacgcccattgaaacggtgttgcctccttataacaaggagataatacttggaatccgccatttcatcgtggaggatgtgcgttcggcgcgccggtttctgaaaaaggtggacaagggaatagatattgatgcgctgacattctatacgttgaacaagcatacgtcgcccgaagacatctccggctatctgaagccgctggtggaggggcagccgatgggcgtaatctccgaagccggttgtccggccgtggccgacccgggagcggacgtagtggctattgcacaacggaaaaacttgagagtggtccccctggtgggaccctcttccattatcctttccgtcatgggttccggcttcaacggacagagctttgccttccacggttatctccccatagaaccggcagagcgtgccaagaagctgaaaatgctggaacaacgcgtctataatgaacatcagactcagcttttcattgaaacgccttatcgcaataataagatgatagaggatattcttcataactgccgtccgcagaccaagctctgcattgcggcgaacattacttgtgaaggggagtatatcaaaaccaagaccgtgagggagtggcagggcaagactcccgacctttctaagattccttgtatttttctcttgtataaataatagcttccaggtgctcgaattcatattccaggcaactgctgaagaagttccgtcccaggttgtgttccatttgctggaatgtccatagctttccccccttgaaattcttattgcataggatggagtcatcgtccaggtctagcgtgaagagatagaccaggcggttggtggcttcattctcaaaatgatacatgaagttgaagtgcaaatggtctaatggggcggtgggaagcgtttgtcgtaaaattctgtgtgcgccttgttccaatgtttctccatatatcaggtaaccctccatcagcaagtcgattttatctttctcgaaaacgttgcatttggggcgggggaggagaaacagcatgctgtgtgaggcaacggcaatccggatgaccggattgatatagtcgtttttccggttgatggcctctgaggcgatggctttccccatgacatctcctttggtgttgactatcggtacgaaaaccgtgtggttcatcactatattgaaatagaaaatgccgaactgattgaacagaatgcctgatataaagacgaggggaggcgccacataaaacagaatgtggcgggtagtgtctcccaaagggtaactgaccagaaccgccaagaagataatcagaaaatgcagcaggcttatgataaggattacgcgtgaggatacgatggcggcttctgccccttgtgcaaaaagttgcttgcagcatttctgtgtctgagacatgtggtagtccagaaaccttctcctattgaggtagatgatgaacggggggatgatggcgctgatttccagcgtgaacggaagcatgaaacggggacagtagtttacgaggaatagggttgttaccgataatagcagtaacattccggtagtacagtaaagtatgatttgcggaacatgcgttcctctatgcctcaccgaatagatgctaaacaagagtcctacacctgcaccgatgtagatggacatgtcctgcgttataaactcgcataatatgatggatattataacggggatgaatcccagcgacatattgaatcttgatgatagaattctttgatggctcattatccgtattatgattttgtcgtttacatcataacaactgggaaatttaaatgtttcctattttacttcttttttgtataaaatgaatctgtttttccgcatgataagaggagcgtaccaatggagcgctttccacttgctgaaaccctttttccaatcctttctctctgtagagtgcaaattgtttgggagtaatatatgctgctaccggataatgtttgtgtgtgggttgaaggtattgccctatggtcagtatgtggcagcccacccggcgaaggtcgtccatcagttcttccacttcttccggagtctcgcccaatcccaccataatgccggacttggtggtagtattgctttctgcaatttgccgcaacacttccaggcttgtttcatacttggcggcactgcgtacgagggggctgatacgacggacagtctccatgttgtgcgaaatgatttccggttgtgcatcgatgacttgtgccacgagttcctttcttccctggaagtcgggaatcagcacttcgacggtggtgtcagggttgagccgcttgatttcccggatggtacgtacccagtgcgacgcgcctaagtcgggcaggtcgtcacggtctacggaggtgacgactgcatgggagagtttcatcaaggcaatggactctgccacatgtgtaggctcatcggcatccagtggcaagggcttcccgcttgccgtgttgcagaacttacagcaccgggtgcagatatttcccccaatcatgaaggttgcggtgcctttcccccaacattcccccatattggggcaacggccgctgctacagatggtatgtaggcaatgcgattcgacaatgcgtttggtctcggtatagcgctcgttggcaccgatgcttattttgagccactcaggcttacgtactctttcgggcattatttcaattctttgttgaagaagttggtcaaccgcgtgtataggtgtaaccgggtatttcctccgtagatactgtggttgcggttggtgtaaacctgcatatcgaactgtttgccgagttgtaccagttgttcggcatattcggcacagttctggaagtgtacattgtcgtctgccatgccgtgtaccagcagcaggttgccgtgaagcttgtcggcacgggtaaaggtggaactggccttatagccttcggcgttttctttcggtgtgcgcataaagcgttcgccataaacggtgtcgtagtagttccagtcggtaacggcagctacggctactccggccttgaataccggtgttccttcactcatactcataatggtcatgtatccaccgtaactccatccccagattccgatgcgttttttgtccacataaggctggttgcccatgtagagggcggtttccacctggtctttggcttccttgatacccaggttcagataggtgcatttggcgaattcggcaccacgtcctccggtgccacgcccgtctacgcaaaccacgatatagccttgtgatgccatgtaggtttcccagcttacactgaacttgtcaagcacttgctgtgaaccggggccgctgtactggtacatcagtaccgggtatttcttgccggcagagaagtcggcaggtttcatcatccagccattcaatgtggttccgtcggaagtctggaaagtgaagaattccttccgtggcatgtcatagccgctgatatcctgcttcaatgccgcattgtccatcaaggtggcaagagtcttgcccgtattgtcgttcagcgtaatgacggtcggagtgtccagattggaataacggttcatatagtacttcatgttcgcactgaactgcgcactgtttgttccggcttgtgacgatagcctggtctttttacctttccggtcaatcttgtagatggcactgcgcatggggctttcctcgttgctgctgaagtagaagcttccttcttcgggatcataacccaggaactcctgcacttcatatggtccggctgtcacttgtttcagcagattgccacctatgctataccagtacagatggttgtatccgctcttttcgctgacaaagctgaaattttccggatagaagacgatgttgtcgaatacattctcgcggatataggtatcgctttcatcacgcagagccagtttggctaccgtgctgcgagggtcggcaaagtataggtcgaaccggttctgatggcggttcagtgtcatgacggcaagcttgttggggtcttgggtaaagcggatgcggggaatatagccgtctgcatctaccggcacgtttatcttgcgggtcactttcgacttgatatcgaaggtgtgtacggacactttggaatttacttctcccgttttaggatatttgtaagtatactctcccggatacttctcgaaaggggtgaagtggggggcttgtccggcaaaaagagggaaagagtaggagggaacatctttctcgtcgaagcggatgaaagccagcatctggctgtcggcactgaattccagcgcacggttgaaggagaactcctcttcgtaaacccagtcggggatgccgttcagcacctcgttctgtttcccgtcttccgtcacctggctttcgctgttgccgtagagcagttttacaaggaagatgttgttgtcgcgtacgaaagccacctgattgccgtccggtgaaaatacgggcacctgttgcgggccgccgtccgaaagcttttccacaatgttgttgattttaccgtccagattgcgctttaggctgtagatgtaatgcacagccgtataggaatgacggtagatgggagttgtttcggtggcaatgagcagcttactgccgtccggagcaaagctgtagctgtcgaatgtcttgaacgtgcattcgcgtgcggtagcggcatcaaacagcacttccacgggttttcccgttttgaaggagtatttgatgatttgtgtcctgtccgcattcatctgcgaataatgttccccgtctcccgggatggggataacgccggaaatgttcttcggagtgaacttgcccgatacgatttctttcaaatcgagcgccttgccattttgggcgaaacctgccagcgtacagaggcagaggagaagtgcgatgcttatctgtttcatatctatcttttatgcttatctgtttccctattttttctggggaacaaatatacaacaaagggaagatttatcgaagcagtgggccgattttattctttttgaacagaaaaagcccgtcctgctccttgggggcgaagcagggacgggcctccgtcactcatggatgatgattggatgagatgatgattggaatatctttcgttacaagcacttgacttttctttgatattctgcaatggctgcatccagtcgttcgtgggcggttgtgtcacccggaacgttgtgcgacggatggatgtacaagtgtacgccacggtcggcaaggatttcggcaacggtagtgatggtcatccataccatggtgacgaaactcaatgtagacaacggacctaccttgtcgaagtggttcttcaaaggtacggaggcgtctaccaggggaacgcaggaatccactacgatatctgccaactggaagaggttctttccgctggagtgacggctggccttgtcgcccgtttcgctggccgaaccgtatacgataactttcatgccgcgcttcttggcttccaatgccatgtctatattgacggcattgataccggtatgtgagaaaatccacatacagtctttggaatcaaaatcatagttcttcatgatttcctggccgtagccttctgcccgttccaggaagaggaactgatgaatacccatctggccgataatctgtgtgaagaatgtcagaggcaattcgcaaagtgggtggaatcctacaaagctgccgatacgcggatacatttcttctacgggaattgttgcgtggccgcaaccaaacgtgtggacccaacgaccggcttcgatggaatctgccataacagtggctgcttttttgatgttttccaactgggtagcctccagtttttccataatgccatgggcattctttaaccattcgagtgctaacataacttttttgttttttaagaagttaataaatttatttgagtgagcgtttatacaaaaggaacatgacggcaagtgaggcaatcatcagataaggataaagcccgatgccattggtgtattgggaaaccattcccatcaggccgttcattgcagtctggccgacgagggctatggcaagcgccacgctgaatgctgttcccgataaggacgggtaccggcttccaagaatgctgagtatcacgggatacgtggccgacagccccatacctaccagtaccatgccgactgccgcgcgtgcaaaccccggcgagaacataaggaaacagaagcctatggcagtgagcgtaaggctgtagggcagcacggtttccggttttatcttcttgaatatcgcaacctgcaccatacgtgccacggtcagtcccgttaccatgcaggtcagtgcaatcaatgcctgattggccggaatatccgtcatctgcccaaagtaactcgtggaccagttgttgcagacaccctcgatgccgctttggaaaaaaagaatgaagctgagtagcagtaagctgctttctttcagcagtcccaatccctcttttaccgggaaaccttgcgcctgcttaggggcggggaagcgtacggggatgcagaatataatgcccgcaagcatcactacgccaattcccagcaagatggtttcgaatgaataatgcctggaaagggagcccagcaacattggtatgcccaatgcgcccagtccgtagaacatgcccagaaaactgaggcgtgagcctttttcggattctcctgagatgtcggataccaatgcattggtttctccgttgaggatgcctccgcccaggccgatgccgacgatggaagcttgcagcagtggcacgctttcaaagaaggcaagtccttccatccccagcagtacgatgatgcagctgggcaccagcagggctttatgtccgaaccggtctacgatgggaccgaaaatcagggaaccggccagcatgcccagaggcaggaaagtgaccagtgaggttgtctgcaacccgctcagattcagcttggctatgagggatggcagcactgctcccaatgtaatcatggagactccgaagaaacacatcccgatgcacgctgccgtgaatacgagattcttgtgataactgttactcatacaagtgatttttgatggcaagaaacgctgctcctatcagtccggcattaccggacaattgagaaggtacaaattccacctgcttgatgctgagcggttgcgcccatttgcaggcttccttgtaaatgtcatctataaagataccggcagggccgaatacgcctccgccccaaattatcttctgcgggttgagcaggctgaccagatttgcggaagccatgccccacatctcgacagctttgtgcaatacggagatggcaatagggtctttttcattataggcactgaacacatcataggccgatatgcggcagatgggtttctggcgcagttttcctttgtatgccttgttggcgcgtacggcatcgcgtacccgtgccccgataccattgccggaagcgtaatattcgaaacatccgcatgcgtcatactcttcccggtagggaggttgcagggccatccagccggtggcgccgataatgtcgttggctccgtgcaacacgtgcccgtcgatgatgatgccggcaccgataccggttcccacggcaatgaatatggcactgtgacattctttggcggcaccttgccacatctctccatacatatagcaggtacggtcgctgtcgatgtatatctcgatgcccggaggcgttacactgcgcagctcctcatagagggggtagttgtcccagcccggtatgttgggggcccatacccggttggtttgggagtaaacgataccggggatgcagacacctattccgtcgacgtgtatacggcttctgcgtgctacggtaagaagtttggcgaggatatccgcggcgagcttgcccacttcgtgaccggttcttcctttcaggagccgtttgcggttaaacatcatgcttccgtccggaaagaaaatggcgctggctatttttgtgccgcctatgtccaatgcgattgttgccatggtgttatagtatttataggttgattcattaaggttgtatgcaaagctatgaatttatttcattcttgaggtgtataaactgaggaaattgtgtgtaaaaagagtgtctaatcactaaattgtgtttaatgtaattacgcttggatgtactctttctcaactaattagttatatatcagtggatgaaacattttttagtgcaggtggaaattctttgttttatgttcgttaacaaatcgggtggaaagtattcttgtttttgcaggttcatcccacggaaaaatcctatatttgccacttacataaggaatatgtatggaaaccaaatctacgctctataatgagttccctttttttctgaagcgatattttccctataaggtacagaaaatatcgctgaatgccggttttacgtgccccaaccgggatggaaacaaaggagtcggcggttgcacctattgcaacaaccagaccttcaaccccgattattgccgtacggagaaatccattacccgccagctggaagagggcaagcagttctttgcacacaaatatccggagatgaagtatctcgcctatttccaggcctataccaatacgtatggcgaactggaagacctgaagcggaaatacgaggaagccttgtcggcagacggggtggtgggcctggtcatcggcacccgtcctgactgtatgcccgacagcctgctggactatctggaggagatgaaccggcatacattccttttagtggagtacggcatagagagtaccgacgacaagacactttgccgcatcaaccgcgggcatactttccatgccgccgccgatgcggtggaaagaaccgcttcacgcggaatcctgaccggtgggcatgtcatcctcggactgccgggcgagacgcacgaaagtatcgtggtacaagccggcgtactgtcccgtctgccgctcactaccctgaagatgcatcagctgcaactgataaggggcacccgcatggctttagagtaccggcagcatcccgaagatttccatctgttcggtgtggacgaatatatcgacctcgtgatagactatatcgagcatctgcggccggacttggtgctggagcgtttcgtctcccagtctcctaaggaactgctcattgcacctgactggggactgaaaaattatgaatttaatcatcgggttcaaaaaagaatgaaagaactcggtgcatatcagggaaagaagtatgaaatgtgagaaaaaagaattatttttgccgcaactttaaatatggaatcaatctaaataaagaataattatgaacccaaaaacagtgataaaaggaaaaatccactacgtgggagtgaatgaccgcaataagcatttgtttgaaggtatgtggccgttgccgtatggggtttcctacaactcttacctgatagatgatgagacggtcgctttggtcgatacggtagacatctgctacttcgaggtgtatctgcgcaagataaagagcattatcggcgagcgccccatccagtatctcatcatcaaccatatggagccggaccattcgggctctatccgcctgataaagcagcattatcccgacatcatcatcgtgggcaacaagcagaccttcggcatgatagagggcttttatggcgtgacgggcgaacagtacatggtgaaggacgaggattttctggctttggggcatcataagctccgtttctatatgaccccgatggtgcactggcccgagacgatgatgacttttgacgaaacggaaggagtccttttcgccggtgacggcttcggctgtttcggtacgttggacggcgggttcctggatacgcgcatcaatctggacagatactgggacgagatggtgcgttactattccaacatcgtgggcaagtacggctctccggtgcagaaggcacttgccaagctgggcggtctgcccatttccaccatctgctccacgcacgggccggtgtggacggagaatatagccaaggttatcggcatctacgacaagctgagccgttatgccgccgacgagggcgtggtcattgcatacggttccatgtacggcaacacggagcagatggcggaagccattgcggcagaactttctgcacaaggcatcaagaacatcgtgatgcacaatgtgagcaagagcaatccttcttatatcattgccgatatcttcaagtatcgcggactcatcattggcagtcccacctacagcaaccagatttatcctgagatagaatccttgctctccaagattctggtacgcgaagtgaagggacgctatctgggatacttcggctccttctgctgggcgggtgccgccgtgaagcgcatgggcgagtttgccgaaaagagcaagttcgagattgtgggcgacccggtagagatgaagcaggccatgaaggacattacttacgaacaatgcgaaaacctggcacgtgccatggcagagcgtttgaagaaggataggaagtagttgaaaattacccctaatttattaacctaataaaacaatcacaatgagactaatcattcaaccggattatcaatccgtgtcaaagtgggctgcacattatgtggctgccaaaatcaaggccgctaatccgacacctgaaaaaccttttgtattgggatgccccaccggttcttctccgttgggcatgtacaaggaacttatcgacctgaacaagaaaggcatcgtgtcttttcagaacgtagtgactttcaatatggacgagtatgtaggtttgcccaaggaacatcccgaaagctactattcctttatgtggaacaacttcttcagccatatagacatcaagccggagaacaccaatatcctgaacggcaacgctgccgacctggatgccgagtgtgcacgctatgaagagaaaatcaagtcctacggtggcatcgacctcttcatgggcggtatcggccccgacggacatatcgctttcaacgagccgggttcttccctttcgtcacgcacccgccagaagacattgactaccgataccatcattgccaactcccgtttctttgacaacgacgtgaacaaggtgcccaagactgccctgaccgtcggtgtcggtactgtgcttagcgcccgcgaggtaatgattatcgtaaacggacacaacaaggcacgtgccctctatcatgcagtcgagggtcccgtgatgcagatgtggactatcagcgccttgcagatgcacgaaaagggtatcatcgtttgtgacgatgcggccaccgaagaattgaaggtgggtacttaccgctacttcaaggatattgaggcagagcacctggatgcggaaagcttgctgaaataagcaaactaataaaagttttgcaattccaccctcaccaccctcaccgcttgtctgcatctgcttgttcatcggtgtttcaggggtgagtgagagcaatttaaaagggtgagggcaaattttgccctcaccctttttgttctcctgattttggttgactgttttcaggacagggcgttatgtgatgaaaacgggctctgctccgctgtaaggctttgggtgccaatgttaaagataccaaatactcactgcaaaaccagtgcatcgtttttgcagtgccgctgcaacatagatgcagtgccactgcaactgttttgcagtgctactgcaacgcctttgcagtgttactgcaaaagatgtgcagtaggtttgcagtgagggcttgtgatgaaaaagccatgggcgtgctttcttttttgcggaatatgtgctatctttgtcatacttgtaatttaaacagtagcagctatggaattgagtggcagacgctatccgatagggatacagaattttgagcaactgcgtacgcggaattgtgtgtatgtggataagacggagctggtgtacaaattggtgaatacagaccaaatttatttcttcagccgcccccgtcggtttggcaaaagcttgctcgtgtctacgctggaggcctatttccaggggaaaaaggaacttttcgaagggctggctatggaacgtctggagcaggaatgggaggtttgcccggtgctgcacgttgatttcagcttgacgaaatatactgagctgcgtgacttgacggggcaattgaatttgtttttatctcgttgggaagaaatttacggaaaaaaggaagaggaagagggggcggcagagcgtctgcaaggcatcatcctgcgtgcctacgccaagaccggaaagccggttgtagtgctgattgacgagtacgatgctcctctgcttgacagtaattccgatgcccttttgcaacaacagcttcgcaacgagatgcgcaagttcttcagtcctctcaaggggctggggcaatatctccgttttctttttatcacgggtatcagcaagttcagccagctgagcatcttcagcgaactgaacaatttgcaaaatatcagtatgcgcgatgacttcagtgccctctgcggcatcaccgaggaggaactgctgacgcagttgaaacccgatattgagcggatggccgaggctaatgatgagacttacgaggaggcatgcttgcatttgaagcggcaatatgacggttatcatttcagtaaggcttgtgcggatatttacaacccgttcagcctgttcaatgctttcaattccaaagaatacaagaactattggttctccacgggcacgcctactttcctgatagatattctgcgccatgcagacttcgatgtgcgtgcgctggaaggtgttgaggctaccgatgagcagtttgatgcgcctacggaacagataacgagtcccatcccggtgctctaccagagcggttatctgaccattaagggctatgaccgtaatttccaaatctatcgtttggcctatcccaacggtgaggtccgtaaagggttcattgaatccctgcttccctcttacgtgcacttgcctgcccagaacaacaccttctacgtcgtctctttccttcgcgacttgatgaagggtgatgtggagagctgcctggagcgtacccgttccttctttgcctccattcccaatgatttggagaacaagaccgaaaagcattatcagaccattttctatttgctgttccggttgatggggcaatatgtggagtcggaagtgaagagttccgtaggccgtgcggatgtggtggtgcagttgcaggatgtcgtttatgtcttcgagttcaaatacgacggtaccccggaagaggcgttggctcagattgacagcaagcagtatgccatcccttaccgggcagacggcaggcgtgtggtaaagattggcgtgatttttgacagttccacgcggacgattggcgggtggaaaatagctaaagcagattagaagaagaaactgttttgattttatatccttctttctcaagtcattttccttttttctttatattattgtttaactttggcgctattaagcggatgcctcttcgagtgcatgggtagaaatgaataagcaacagaaaggaaggagtagatgaaacgctataagaagattcttatgatatggatatgtgccattgtagtggtggcagtgtctgtgatagtagcattatatgataatgccaaccagggacaagacgtggctaaggaggttgctgtagaaactctgcggaaggttgcggaacgggtcgtgaatcgggaatttgatgggctggggatgttctatgcatttgggtctgatagtggtaagaagcataccaaaaggaaagcgatatcagaaaatggtgaatttgaagtgataatagattcattgaaagaggcacaaggactattcccgttggatgtcgtagggtttaaagccgatatgttgaattattatggaaaatttccattggaagagatttgtcttgagtggaaagctgagatgaatgataggtatggcggagtcatgtgtgctctttttctgaaggttaatccgatgggaaagggcattgtgcaagaattatctactggagatgaaactataattgcttcacagaatgatttaggcacttactatttggacgatatgtacacaatgaggttgacagcttatatgctgcttgatttttggcactgtgtggattgggcagaccatgtgctgcagatactatcctgtattttgtgcattctgttattgggactggcggtttatataggagggcaacagtatagaaagagaaaaacggctgatacgttgacaaagagcacttaccggttcgggaagtatatatttgattccgtcaaccatacactgacttatgaaggtgaaaaaatatcttgtacgccacaagctgcgaagttattacttggttttgccaagtcgtccgaacttttcctgacgaacgatgaaatagcggaaatttgcggttggctattgagtgatttgaatttaggcagccgccgcagaaaagcaataagtttattgggtaaactctttgaggcggacgattccgttcagattcttcttctgccggaaaggaaggggtatcaaattgttatctccaagtagatgaaatgttaacccatattggtgtgtcgggtgtgaactttttttcacgccccaactttgggcgttttccgaataaagacttgcaaaagccaaaataatccttttatctttgcttgtgtaacaaaaaacaaaaacactatgaaaagcaaggtgaagctattaggaactttggcaattagtgccatttcgtttttaagctatgttcaaattagtcattcggaaaagctagatgatttgctattggaaaatatagaggcattggctgctggtgagagtggggatgatagcaaatgttttgggagtggttcaatagtttgtcctttaacaaatcaaggagtagctcatgtgcaaatttattatagcctgcctcattagcctatccgcactgtccttttcctcttgtacacagaaaaaagtagcaacttctgttgcctacatggattttccgcaaacaatcgagctgaaagcgagggtgcagccattggacaccgctttgttccgttatccgttccgcgttcgggtgcagggtgataaggctgtggtaatggatttgcatggcacggactacttttgccatgttttccactatccgggtttccgctatttggcttcgttcggcaagcggggcgaggctcccgaagagatgctttctgctgaaaatatccgatggcatggtcaatctctgtggggacttgatgctggtaagtccgtattgaccaagtatgattttacttcgtcgggttgctcaatcgttcctcagaaagtgataaatatggatgctgacatgcttcgcgttttagactttgtgatggttgacgactttaccttcattgttccggacggatctggcagcagccgcttttgctgggtaaactatcaagggaaattattgcgcagaaccggtcaaataccgtcagccaatgcggaggctttacagaatgcccgtcctgcattggctcaggcatggcgtagctttatcgactataatccccgaaatggagtgctggcagcagttacccagttgggcgaagtacttgaagtctttaatttgaaagatagtacgcatgtggtacgcattggtccgcacggtgaaccggagtttaagatttctcagggttatggtattcctacgggtatcatgggatttagcgatgtccaagtggcagacagtgctatctatgcggtttttcatgggcgctcttttaaggaaattgcgcaaaatgtacagcaaggtgtctatttgccggatggaggacggtatatctatgtttttagtctgactggcgaacctctctgcaggtatgtgttagatcattatgtttatggcatatcggtagatgaacaaaaaggaataatcttggcaacggatgtgaataaagatgatccgataatagagtatagtatgaaataaagtaaactataatatggatggagaggaacggacggttcacgtttggttggtgcatctcgtaccgtccgttccataacccaccaagaaaggaggtcgaggcaaagatagtaatttgaattgaaaacagagtgtgttttctgccatttcgataggtatggcaagaaaagagttctccaagatttttatatcttgattctggtacgcaagcattatgcttgtggtaaatgataaaaaaagaataatcttatactaataaaactgaagagtagtatgaagaaaatgattaagatagcttttgttgcagcatttgcagcgattgcaggatatggagtttatgcaaatcagaaaacagatgttatgtctgatttggcattggctaatatagaagcattagcagatggtggtgaaggttctggtgattgttatggttgtgctatatatgcaattggtatctgtaaagattggggatggggtggatgtaaaggacaatcgcttatacactatgtttaattaataaatataaatcaagaaatagtatgaaaaaaatattaatattgtttgttgttctgttttctttaatcagtgtagaaagattgcatactgtagaagatactgagcggatatgtgagttgctgttaaagaatgtagatgctatggcgtctggtgcagagattataataggtccattttgtattcaaacagatcgtacatgttttgtagattatgatggcttttttgtaagagggtatcgtcagtatttctagtaattcattttattggataaatacagaaagtaattcaggagaactcttctttgttattcaaaataaaagacaacgaagaagagaattctcttgattatatgttaatatactaatatttttttattctttattatgaaatatttattggttctaattttagtagtttcattttcatcatgtacaaattatgatgaaaaaatgagaaaatttgatgcttcatttacaaagatgcgtaaaattacttctgcgaatgtcttaaatcatgaattaattttagggagaccatatattattcattatgctgattcatcggttgttatctatgatgatataaatgatagtatatttacattaatagatttaagagataataattctgtatatcattttggaaaaagaggggaaggtaataatgaattccttcaggttttttctttgtgctctttgtatggagattcgttaattggggtatatgatgtttataagcggaacctagtggaaatgaatctacggcaaattaaacaaggaaacattcaatttccagtgttgatgcaggatagtctgatgagcttaaatatatgcccaactcaatatgatacatatttaggattagggttttatgaaaataatatgtttagtcttactggtaagcatattggaagtaggtattactacgagtatccttatcgtgataaacaagaaaaagaagttaaaaatcgtttaagaggaatggcttatcaaggaacgttatcttctaataaatcattgaatcgatttgtctttgctatagggtcagcacctatattttcattgtattctgtaaataaagataatatagataaatcatttgaatttgtaggaggataccctgaatataaaacagaagatacaggtacaactaggtcggccccaatgagtgtagctaataaaatggcttttattaaagcttatgctacagagaagtatgtttatctactgtattcaggaaatagttataaggaagttggtgtaaaggcttttaatggaaaaattatttatcagctagcttgggatgccactcctatatgtaagtttgtcttagattttccaattatgaatttttgtgtatcagattcagatgatacaatatatgctttaatggataaagaggaagtagaattggttaaatattcgttgaatttgtagttatgaatcgtattttatatatttctctgtcagttatactatttatttcttgtggaaataaggatcgagaaatactcgtaaagttaatgcaagagtggaaaggacgtgaaatattgtatcctaatgatatgcatttttttatgcaaggtcgagatactttgaatgcagattccatatgtatgtataagataataacctatatagattcgataggttgtatgagttgtaaattgggtttatcacaatggcaagattttgcagtaaatgttgattctatatttccgaatactgtgcattttcagtttgtttttcagccatataagcttaatgaaatacggcttttgttaaagagagaacggtttaatcattcggtatatatagataaaaataataagtttaataaattgaataaatttccttctaatatgaattttcaaacttttttgttagatagaaataatagggttattgctattggtaatccaatttataatcctaaagtgaaagaactctatctgaagattattaaaggtgagaagatagaacgaagagatgaaagtaaagtgataaaaacagaagtggatgccagcaatatatctgtttcgctgggtcgttttgattggcaggaggaacaaaaagcaacttttatattgaagaatgtgggtgacaaaccattggttatacaagatgttgccacttcttgtggttgtactaccgtagcttattcaaaggaaccggcattaccgggtaaggaaatagctttggaagtggtttataaagccgaacatccggagcacttcgacaagacgataacggtatattgcaatacagaaaattctccgttggttttgaagattagtggggatgcaaaataactgattgatgggatgaaggagcggctgcaattgaaaaaatggttgaatggaataacaaacgtattattctgtctgtgcctgcttgttgtgatactgatagtattgcaggtgtttgtggtgacctccttcaagataccgtcggactcgatggaaccgtcgttgctggcgggtgattgtattctggtggataaatgttcgggtggagcacgcctattcaatgtgcttgatgccgtggagaaaaaggaggtgaagatacaacgtatgtccggatggagaaattatcagcggaatgatgtgttggtgttcaattttccttatccgggcaggtgggacagcattgcgctggacgtgatgttgtattacgtgaagcgctgtatcgccatgccgggggatacgttggagataaggaatacgcattatcgtgtgtccggatttgatggtatcgcaggaaatgtgcaggcgcaggaggaattggatgaattgatatcttcgggaatgacggaggagcggggccttgttcttaagagctttcccgatggtggctgtaatgggtggactatcagcgagtttgggcctctttatataccggccaaaggcagcgtggtaggaatgaatccggaaacacggttgctgtatcggaacgtgatagagtgggaacagaaaaagaaactgacattgcatggagattcggttctgctgggggacagtgtgatacacaattaccgcttctgtgagaactattatttcgtttcgggtgacaagatggtgaattcaaaagattcccgctactggggattactgccggaaccatttatagtgggaagggcatggctggtatggaagtccgtcagcccgaatactggaaaaatgagatggaaacgtatctttaaaagaatagactaagatgaaagttctgtttaaattgctctggatattattgattgccgggatattggaggcttgcaatgcttccggcagattggagtacgcactggagtgtgctgcaaccaacaaaggcgaactggaaaaggtactggaatattataaagatgagcctgaaaaatataaagccgcttgtttcttgatagaaaatatgccttatcactatgcccttgaaggtgaagaactggattctttgaaaacagtgctggcttcggcagatgcttatggggtgatgctgaaggatactgccgtaccggattgggattattataccccttccggattgcagagaaaaccggatgtactgaatataagggctgaattcttgataaataacattgatttggcttttgatggttggaaaaagcgtccgtggaatgcttccctttcttttgcagatttctgtgaatggctgcttccctatcgtatcggaaatgagactccggacaactggcggcagatataccatgaccgttattcctttttgctggacgaggtttatacgggtatcgatgtagtggaggcgattagcgtagtttgggagtatttgcagaaggaagacccttaccggtttacatgggtctttaactatccgcatttgggaggagagtacctgctgcataatcgtatcggcaagtgtcaggatgcttgtgattttatgatttatgtgatgcgggccatcggcgtcccggtagcctatgatttctatactttcaatgcggaaacacggaaagggcatgtgtggaatgtggtgagggatgtaacgggtgtctgccttccttttactttcccttcccggaagccggaacggggaagtttctatattgacagtcggcgcccgagcgtggtttaccgccggtgttttggcagacaatgggacatggatggcgattttatgcggaaccggtccgtaccggctgcttttaaggatgtgtttgcaagaaaagtgtcggataattattttgattcgaatctggaactgccggtagaagggatggacgggaattatgtttatgtggggttgttcagtgcttatgggtggcggggaatagattttactaaggtagaaagtggaaaagcgcttttcaggaatttggcttcgaggcaggtttatatattgttggcattcgcaaacgggcagtatcgccctattggaaatcctttttattttgatggcaaggatatacatccttatgttgcagatacctccaagtgctattctgctgaattgtatcggaaataccctctttcggaacgtatcaggaattatatgggagggataaaagacgggcattttgaggcggcttgtgataaggattttaaaaatgcggagttgttgtgtactgtgaaagatacgcccggtatcaattataatcacgttattcttgagaaaccggtaaggggtcgctatgcccgtttttgttcttcggcagagggatatgcggaagttgccgaaatgcatttttataaaggagaggaagagattgtccctatagacagttggggagatgctccagccacagcaaatacttttgcctatcaggtctatgataatgaaccgttgtcgtatttcatttcatcaaaacccggtgcaagtgtaacggtggattttggaaaggttgttactatagacaattttatgtatatgccccgtaacgatgataactttgtcaggataggggattattatgaactcttctattggggagagggctgttggaactcattggggaagaaaattgccgaaaaaccttttctaccatatgacgggataccatcgggagctttgctctatttgcatgacagtacccgtggagaagaagaactgatatttcatatggaagctggtaagcaggtatttgtatcggattgtaaggattgattggactgcctttcagattggaatagaaaaaatggaatagtgatatgaaacattggtgtgtatgggtatggtttacagcaggtctgtttgtggcttgttcttcggaaaatcagtggttggacacagctttgaatcttgccggtgataaccgtgcggagttgcaaaaggtactggaccgttacaaggaagaggacggtgacaaatatcgtgctgcttgttttctgatagagaatatgccttttcatggtgcttacgagggaaaggccttggagaattacaggaagtatttcagtgaatacgtttcatttccttattccaggcatgtgcaagagttgattgattccttgaaaagagcagatggagaattttctataaatcaattgacttataagagggacattatgacggtggattccgcttttttggtcaatcatatagaatgggcattcaaagtctggcgggagcaaccttggggaaagcatgttgattttgatactttctgcgaatatatattgccttatagaataggggatgagccgctttctctctggcgcaaagaaatttatgagtgctatagcccgattttggatgaattcaggaagacagatgaggctgataatcctaaggttgccgcccagttgttgatggatacgttgcggaaagcgaactaccggaatacggctctttttccggtgggacctcatttgggaccggatgtactgaaatggcatacgggcagttgccgagagtttacggatgccatgatatatgtgttgcgggcattgggcattccgtgcggagtagatagggtgatggtattaggagacaacaatgcctctcatttctggaattttgttttggataaggaaggaaagacatacattgcaaatcttccttatgaagaagtatggagcaaagcggaagaatatagcatttcgaggggaaaaatgtaccgggcaacctatagtattgataaggaggcggtacggaaactggggaaatattccgatgtttacccggcattccgacgtccgttcttccgcgatgtcactgcactttataccggtaacaggaattggactgtagctcttccggattctttgctttccggacagtttcgtgagggggatatggtgtatttgtgccttgccaacagactacaatggcaacctataggatatactttctttaagaagggggaggctcgttttgaggatgtgggaggcggggcggtctttacgctggctgcctggaacggaaaggaatacgctgcagtatcttctccttttcttctggagcgtgaaaccggaaagatacggttcattgttccggaagctgaaaagcaggaattggtcttgtataggaagtgccatcttactttgagtgttcttttcaatgaccggatgattgggggagtagtggaaggaagcgaccgggcagactttgggtggaaggatactctacttttgataaaggaggctccgtatcggctatatactgtggcccggttgaagtctgataaaccgtatcggtatatgcgctataagggtgctgacggatgtttctgtaatatctcggaactggctttttatgagaatacggaagataccatacctctatatggggaaatcataggtactccgggaagttttgaagacaatacacatgaatatttgaacgcatttgacggtaatccggatacttcatttgattatatacatccggatggaggatggaccgggatggactttggaagtccccatcgtgtggagaaggtggtgtatactcctcgtaatgaggtgaattttatttataaaggtaatttgtatgaattgttttattggggtggaggaaaatggaattctgtcgggcggcaaatggctgtgtcagattctattgtctattcagggtttcaaggtgctttattttatctgaagaatcacacagccggtaaagatgaacggatttttgaatataaagacgggaaacaaatcttttggtgaattatagaatactattgaatatttgatagatagaatgaataatgtacgtaatctattggctggaagtttggtctacattgcttgtatagttttattgtctttggcatgtaacgtttcttccggacttcctgtagctgatgttatagggcaatggctctatttcgataaaagtgcattggtagttgcaggatgtctgttgatggctggattgatgatggaaaaaaggtattttctttttataccggtttcgtgggtattggtaatgctggggggcattgaggctgtttggggattgaggcagctttatggttatgctgtgtccaaccattccttgtatgtattgacaggttctttcttcaatccggggccttattccggctatttggccatgatacttccggtctgtctgtatcaatggctgaccaagaggggggagattctctgctctgaccggaatgatggaagaagatgggaaaaggtgatggataaggctggaactatggtcgctggtggtgtgatgctgcttatcctttgtgtgcttccggcaggaatgagccgttcggcatggttggcggcaggagtttcctgtctgtgtgtatatgcttggcatatggattggacggataagttcagattattatggcagcagcaaaggcagcgtgtggtgatggtagtggtcggtggattctgtgtcttgctattggcaggctatttactgtttgtcttgaaacccgattctgcacgtggccgtcttttcatgtggaagataacttgtcgtgccattgcagaaaagccgttgaccggatatgggattcataatttcgcagcagcctacggaaatgcgcaggaaacttattttgcagcaggtgattatgaactgtgggaggaacgtgtggcgggaagtccggaatatgcattcaatgaatatctgcaggctgcggtcgaactgggcattcctttggctgtatgtctattggttgtggtcgtgctgtgtttgtataggggagtccgtaaaggacgttatggtatctgtggggctattctttccttgatgatattctctttttcctcctatccgctacaacttccggtatttatcgttacatttggaggattgcttgtggcatgcttgtccggtgccgaccgttggcaatggttgggggtggctgtattagtaggcatcattggcggttttcgcctgaagaatgacttgcaagtggagcaggcctgccgggagtggatgaatgctcgggtgctgtataatgcaggtgcgtatcaatcggcagagaaagagtatggacgtctttatcctctgttgagggaccgggcatctttcttgttcgaatatgggcatggattgcacaagcagcagcagttcagtaaatccaaccgtattttgaaagaagctttacagcgtagttgtgaccccatgatactgaatgtgataggcaagaactatcagcagatgggtgactgcttgtcagcggaagactggtttatccgttccacccatcggttgccgggacgtatttacccttattacctgcttgcgaaactttatgcggaaccaagcttcaggcaaccggacaagtttgaaaaaatgaagtggatggtattgacgaaagagccgaaagtgcattctacggcaatacgacagatgagggaggaaataaaaaagattcagcttatttttgtccatattaaaaaagatgaataaaaacggaaagtgttaataatgagcgaactaattgctaaagtgctatgaaaaaagtgtccacatgcaaatatcggttcgtttttttgaaacgattaattttatcaatttataattgagtatgaatatgaagacacagaactatcgatacctgctatgcatggccgttgccctgcttgccgcctgctccgatgccggaaagggaaaagagtccgaggaaggggtggcaaccgtcctgccaagtgaaagcaatgaagtgaccgtgaaagtcctgaagcgggcgacctttgagcatgaactggtgagcaacggaaaagtaaccgccggtgccatggcggatttgcgttttgagaccaccggtgtagtggcacacatctacgtgaagaacggtgccccggtgcgcaaagggcagaaacttgccgaactggataagttccgtctgaagaacaagaccgcgcaagccaaggatgctctggacaaagcggaacttgagctgcaggacgtattgatagggcaaggctatccggtgggtgatgcctccaaagtacctgctgacatcatgaagctggcccgcgtgaggagcggttacgaccagagcctcgcccagtatgagcttgccgcgtatgaagaggaacacgccacgctggttgcgccttttgacggggtagtggcgaacctgttctccaaaccgttcaacgaggcaagtacctcggaagccttctgctccattatcggcactcaaggtatggaggtggacttcacggtgctggaaagcgaactgccgttgataaagagtggcgacaaggtgattgttaccccttattcggatgccggctttaggcaggaggggcgcatcacccaaatcaatcctctggtggatgacaaggggatggttaaggtgaaggctgccgtcaatggcaagggacggctgttcagtgggatgaacgtgagggtgaacgtgcaccgctctctgggcggacagcttgtaatcccgaagagtgccgtggtgttgcgttcgggcaagcaggtggtgtttaccctgaaagacgaaaaggcgcagtggaactatgtgcagaccggactggagaatgcggaaagctacagcatggccgacgatgccctgaaagaaggcgatacggtcatcgtgacgggaaatgtgaatttggcacatgaggcgccggtgaaggtggtggaaaattgaaagatgaaaattgaaagttgaaaattcataattcacaatttaaattcataattgaaaattgataaagtttttgatacagcggcctattgccgtactgatggcatttacagcatgcttcattgtcgggctggtgacttacttcaccttgccggtatccttgctgcccgatattgccatcccggaaattacagtgcaggtgtcggcgcagaatacctcggcgcgtgaattagagaatacggtggtgaaacctctgcggcagcagctcatccaggtggcgaaactgaaggacatggacagcgagacgcgcgatggtgcaggcatcatccgcctgggcttcgacttcggtacgaataccgaccttgccttcatagaagtgaacgagaagattgacgccgccatgaactatctgcccagggatgccgaacgcccgaaggtgataaaggcaagtgcgacggacattcctgtcttctacctcaatctgaccctaaaaaacgacagtgcatacggcaaggtggacgaacgcgcgtttcttgatttgtgcgagtttgccgaaaatgtcataaagcgtcgcatcgagcagttggcagaagtggcaatggtggatgtcacgggtttggtcgaacgccagttacagattgtgcccgacccgggtaagcttgctgtgttggggctctccattgaagacatagaaaacgtgctggcgcaaaacaacgtggagccgggcagcatgaccgtgcgcgacggctactacgaatacaacattaagttctccaccctgctgcggacagaggaggacgtgaagggcatcctgctgcgaaaggaaggacgtatcatccgcttgggagacttctgccgggtagagattgttcctgccaaggagaaaggtgtctccatgagcaatggcaagcgtgccgttacccttgccgtcatcaagcaggcggacgagaatatggaagacatgaagcttgccatcaacagcacgatggactacttcaagaaagtatatcccgacattgattttagcatcagccgtaaccagacggagttgctggactataccatctccaatcttcagcaaaatttgtcgttgggtttcctgttcatctgcattgtggcggtactcttcttgggtgacatcaaatcaccgttcatcatcgggttgagtatggtggtatctattgtcatctgcttcctgttcttctacttgttcaagatgtcactcaatatcatttctttgtcgggattaatcctggcgttgggtatgatgattgacagcagcatcattgtgacggagaacatttcgcagtatcgcgaacggggctattcgttgcggcgggcttgcgtgacgggaacgagtgaggtgattacgcccatgctgagttcgtcgctgaccactattgccgtatttgtgccgctgatattcatgagcggcattgcaggggcgttgttctacgaccaggcattctctgttacggtagggttgctggtttcctacttcacgggtatcatgctgctgccggtcctctatatgctggtctaccggacggggttgcgcggcaggtcgtggttctcccgcatccgtatcaacaatccgttgaaggaacatacgctggaccgtttttatgatgcgggcatcgactgggtattctcccacaagacggtaagtagcgtattctgtgtggtttctatacctctttgtgtctttctgttctattccgtcggcaaggagcgtatgccgcagatagaccagaatgaactgatagtccacgtggaatggaacgaaaacatacatgtggacgagaaccggcatcgtgtgaatgtgctgttcggacagttgctggacgagactgtggaacagacggctgccataggccagcaggactatctgctgaaccgtgagcaggctctctcttcttcggaggcagaattgtatttcaagacttcctcgcctgacgggattgctcccttgcagaagcaggcgggcgagtggctgacacgggaatatccgttggcgacagtctccttttctccacccgaaaccgtgttcgagaagcttttcgtgaccggggaggccgatgtggtggcggaactttatgcccgcaataaggagaaggcgccggcggcggaagaattgcgcggactggaacaacagtttgcggagcttacggggacagcgcccgtaggtatcgctttcgagaaccagcttgacataagcatcctgcaggaaaagctgttgctctatgacgtttcgtatgacgagctttaccgtacgctgcggacggcattcaaggagaacagcgtagctatgctccattcctaccagcaatacctgcctatcagcattgtgggcgaggagcggacagtgaacgaggtgctgcagcagacattgatacagacccgtccggacagtaagggcgaagtggagcatattccgcttcgggagctggtaaaggtgcgtccggctgaggacttgaagacgattacggcaggacgcaacggtgaatatataccgttccgtttctatgaagtggacaatgctccggagttgatggaaaaggtgaagcgggaggcagatgccacgggtgactgggatacggccttttccggcagtttcttctccaaccgccaaatgctggacgagttggtggtgattcttttcatctctatcttgctgatgtatttcattcttgccgcccagttcgaaagcttcgtgcagccgctcatcgtgctgctggaaattccgatagatgtggcgtttgccctgcttctgttgtggatatgcgggcataccctgaacctgatgtctgccatcggactgattgtgacgtgcggtatcatcatcaacgactccatcctgaagctggatgccattaatgaattacggaaagaggggatgccgttgctcgaggccatccacgaggcgggacggagaaggctccggcccatcatcatgacatcgctcaccacgatatttgccatggttccgctgctgttctcgttcgatatggggtctgagttgcaaaagccgctttccatagcgatgattggggcgatgttcgtggggacactggtcagtctgttcatcatcccgttgatatattggtttatttatagaaaagaaagagcatgaagaaattaagtcttatacttttgttcagtctgggagccttttccgcttttgcccaacagcggataacgctcgatttgcagcagaccattgccctggcgaatgacagttcgctggaagccttccgcaccaagaacatgtatctggccggttattgggaataccgcacctataaggcaaaccgccttcccagcctgacgctgaacatgactccggcacagtacaaccgcgatatcaccaagcgttacgactccgaacaggaccttgacatctatcgcagccagcaatccttctatgcatacggcaatcttgccgtcagacagaatttcgacttgacgggcggtacgttctatctggatacggagctgggctatatgcggagcttcggtggaaacaagtatacccagttcaccagtgttccggttcgtttgggctactcgcagagtctggtcggttacaatcctttccgttgggaacgcaggattgagccgctgaagtacgaaaaggtgaagaaggagtatatttacaatgcagagcgagtatccgagcaggccacgacctatttctttgcgcttgccatggcacaggcggaatatgacttggccaaggacaatgccgtctccaccgataccctctaccgcatcggcatgcagcgcttgaaaatagccgccatcagccgtgccgacctgctgacgctgaaactcgacgtggtgaacgcccgcaatactttgcagaatgccgccagtgccttgaagcgcgccatgttttcgttggcatctttcctgaatatggagaagaacacggatatcagggtgtcgcttccgggacgtccgagggcgctgaccataccggttgatgaggctttgctggccgctcaagccaacaatccggaatttctggggcttcgtcaggaagtgctggaagccgagcagacagtagacaagacgaagaaggaatcgcgcttcaacgccagcatcaacgccagcgtcggcttcaaccaggtggcagagaaattcggtgaagcatacaggcatcccatgcagcaggagatggtgtcggtcagtgtctccattccactggtggattggggcgtgaggaaaggcaaatacaacatggcgaggaacaatctgaacgtggtgaagacttctgcccggcagagtgaaatcagcattgaggaggaggttatcatgaccgtcagtgacttcaacgtccagcaagccctcgtcgccagtgccgaagaggccctcgaccttgccatcctggcgtataacgaaacccgccagcgcttcattatcggcaaggcagacatcaacagcctgaccctctcgctgaaccgccagcaggaagcgcaacgcaattacatctccgccttgcaggactactggctgaattattacaagatacggaaactgacgttgcacgactttgccagcggattttcgctgtcggaaaaatttgattataataactgatgaaacgagtttcttccttcaccgtcatagtggcgtttgtctgccttgctttggtaggggtggcgttgataccgctgctccccgtcaagctgaatccgtcacgcagcctgcccggcttcacggtgggtttcagcatgcctggcacttcgtcgcgggtggtggagatggaagtgaccagcaagctggaatccatgctggcgcgtatccgcggagtgaagcggctgaactccacctcgggcaacggctacggcaacattactgtggagctggacaagcatgccgatgtcgaggcagtccgcttcgaagcttccaccatcatccggcagacgtggccccaattgcccgaaggtgtcagctatcccaccattcacatgaaagtgcccgacgagaacgcctcacgccccttcatgtccttcaccctgaacgccccctccaccccgatattgattcagcagtatgccgaggagcatatcaagccgcggctggcaaatattccgggtatctataaggtggaactcagcggtgccacgcccatggagtggagactggaatatgacagtgaacagttgcgcttgctgggtgtggcactgtcggacatcagcgaggcagtacagcggcattaccggaaggaatttctgggtacgcacaatgtggatacaggtaacggtagccgggaatggatacgcctggcactggtgccggagagcaactcccttggttttaatcctgctgccatcaccgtgacggctaccgacgggaaactgctccgcttggacgaactggtgtcggctgtccgtatggaggaggagccgcaaagctattaccgcatcaatgggctgaattccgtctatctatccattactgcggaagaaactgccaaccagttgcaactgaaccgtgccgtgatggacgagatggaagctgttcggcaggtacttcctgtcggatatgaagtgcataccagctatgatgcgaccgagtacatacgggaagaactggacaagatttacttccgtaccggtttgacggtactcatcctgcttgtattcgtatggctcattactcgtaagttgaaatatctttttctgatagttaccagcctggctgtaaatatagcggtggcacttatcttctactacctcttcggacttgagatgcagctttattcgctggcgggtatcactgtctcgctgaatctggtgatagacagcaccattgtcatgaccgaccacattctgcatcggcgtaatctcaaggccttcctgtcggtgttggcggcaaccctcactacgatgggtgcgcttgttatcattttcttccttgacgagaagatacggctcaacctgcaggactttgcagcggtagtgatcatcaatctggctgtttccttgatggtggcattgttctttgttccgtcgatgattgagaagataggactggtgaggcggattacggggaagaagaggcgtcttgtcttgccggggctgacgcaaacattcaaaacaaggttgggacggattttcagacgtttccccgtttatttctcctgctgttactctgctctcatccgttttctgtgccgttggcgctgggctgtatgcctgctgttactgttgggtttcggtctgcccgtttttctgttgcccggcaaactggaaggagggggaaaatgggaagctgcttacaataaggtattcggttcggatacctataaggagtcggtgaaacccgttgtggacaaggcgctgggcggcagcttgcggcttttcatacagaaggtgtacgaaggcagttacttcacccgtaatgaggaggtggtgctctatgccaacgccaaccttcccaatggcagcaccctcgagcagatgaacactttgatgaaacgtatggagacctacctcagccggttcaaggaaatcaggcagtttcatacttccatttacagcccccggcgtgccagtatgcagatttattttaagaaggaagcccggaacagcggttttccctatacactgaaagccaatatgataagcaaggcactggaactgggaggcggcagctggggcatctacggattgcaggaccaggggttcagtaatgacgtccgcgagagtgccggctcctaccgcatcaggatgtacggctacaactacgacgaactctatgagtgggcggagaagctgaaggccaagctgctgacgcaccggcgtatcaaggaagtgctcatcaattcggagttctcctggtggaaggatgactatcaggaattctacttcaacctgaacaaggagcgcatggcgcaagagggcatcgacgcgcaagtgcttttctctgcggtgcgccccatcttcggcaagaatctggagattggctcggtagcggccgagcagggaacggagaaaatcaagctctcttcccgccagtctgccgaatatgacatctgggcaatgcagttctttccctatggagtaggaaacggcaagcattacaaactttccgaactggctactgtggaaaagggacagatgccgcaggagattgccaaagaaaaccagcagtaccgcctctgcctgcaatacgaatatatcggctccaatgagatgggcaacaagatacagaaacgtgacctggaggagttcaacaaactgttgccgatgggttatacagccgagtcggacagcaacagttggtcatggggcgagaaggacaaccgccaatacctgcttctgctggtggtgatagccatcatcttctttacgaccagcgttctgttcaactccctgaagcagccgcttgccatcatctttgtgattccggtttcttatatcggggtatttcttactttctattggttccggctgaacttcgaccagggcggttttgcctcgttcgtcctgctgtgcggcatcacggtgaatgccagcatctatgtcctgaacgagtacaacagcatccgacgtcgtttcccccgtctttccgctcttcgtgcctacgtcaaggcgtggaatgcgaaggtcgttcctattttcctcacggtagtttctaccattctgggatttatccctttcatgataggtgaggacaaggaggctttctggtttccattggcggcgggtaccattggcggactggtgatgtccgtcatcggtatcttctttttcctgccggtttttgtgttgaaacagcgtgattttcttaggaaatgattacttttgctcgattttgttacctgaatggatacttgaattttaaatatggaaagtgcggagtactctttggatgagttattatgtcagtctcttctgttgtttcgtcagtatcggttttatgatgctccagaatgtggagaaaaggcattccggatattggaggaagcccatgtatggatggggcgtacgcaagagtgtgtggatatggcgaaatgggggtgcgtgatagagtgtcttgcgcagaaatactacatagaagatgatacggatgcgattctggaagaaattgatgctgccttggttgcgcattggaagaggatagagaaaatccatgcagaagtcaccaccgtttatttatggctggggtactatttcctgctacgtttcagaaaccgggaatcccgttcccattcccgttgtaaacagataatgtccagcttgttgtgtgctttggtcgaaatcttccgtaaggtggagaaggggggagccccgacagaagtcttgtcacatctttcggtagatgtttggggagagaccgtctgctggatggagcaggtacatgattcccgtctttgcgagaagcagtcgtcagctttgctggcacaactctataacctgaaaagtgtggagttggaaaaaggtccgggaaagcaggatgctttgctccagcagattctggagttttattgcttttaagggaaaattatctctgcttagttttatcatttctgcttccacacttccacctacttcctgcatccctttattcatcggcattacaagtgctgtggaagcaactcaaaaaggtggaagcaacttttgcttccacagcggaaatacgccgaaaagtaagttaatatcttgtttgttagtgtattaatagaatgtacagcattttgcaaatatcttgtttacacgatatgcgtttcgtgtaaacacggtattaacttcgtaaaagaccgtttaccgatagactgcagctgggctcataataggaataagataggtgcacagtatggggaaactatgagtataataggtgttcaacggttatgaagcaccttgttgacggtcgttagtcgagtggttgacggccgttggcagagcgcatcacggccgataggcgctgataactccgtacagaaaatggaaaggaagcctatgtaaggggaaacaagctctgagctatttgttttgtttgccacatttatcttgtttttgtacattattgaagcggttttttgtatctttgaagggaggggctgtaaaaagcttgttctcatccaaagtttaattatatatacatgaattatgaagcgatgtatagtgctgttcataacattctgctgtgcagttgtttctaatgcgcagacaaatggcattgtgactgatggggaaaaaggattgccgttggctggtgtgaatatttatctccaaaaggattctgtgggcataggagttatacgtaatgataatctggtaaagaacatgttcatatgaaaaaactgctatatcttggacttttgtccgtttgcgtactgttaggttcttgcgtagagaagaacgtattcaatgcttttgataaggtagagaggtatatggatgtatattctgacagtgcattgctgctgttggagcaaattcctcatccggagaagcttcgtggaaagcagcgggcagactatgtgctgctgttgacacaagcccgtgataagaactatctggatagcatgcagtcggattcgttgataaagttggcggtagattattataagaatgggggtgataacgtgaaagcggggaaggcattgttttattatggcaaagtgatggatttgcaggggaatgatacgctggctatgcaagcctatttgaatgctttggctaaattggagaaaacggaagagtataagctacaaggcttggcatatgagtatatcggtattttgaatgcagatagaaagctacacaaagatgctcttgataattatcaaagttcggtatattgttttcaaaaggcagccgatactttaggggttatatatgcttatcgggatattgctcgtatttattatgtagaacaacaatatgacagtgtttataactacatcaatagggctttgtccttgtgtgaagaaaagaaaggatgtatcgattttgaacgagtaactccttctttgttacaagtaaaaggaattgcaaaaagaaatgagggagatttggaaaatgcaataatcttgttgaaaactgcggtagagactgaacaagataggcattctatgcatcactgttcaatgtcattggggaacatttatttaaatcaaaataagttggatgaggcaaaaagatattttactttagctttgaaatcagaaaggcctcgtactctggcaggggcataccactatttgtatctgttggaaaagaggcagaaaaagtatgcaatggctctctatttcaaagagaagtctgattcgttgttgtccgttgacctggatgctaaacaagcatctcaaattttgactttgcaacgtaaatatgaaaaaggaaagcttcttttagaaaagcaacaagttgaacacgaaaagaaaatacagttttattttgggatggtaatcgttttatttattatcctattatgtcttgttttgtattttcttttaagaaaaagatacaaagagatgttccggaaaaatatgcaagtaataaaggagaatgagtgcatgattaaacgatatgtttatgaacttgatgtgttgaaacaaaaagcaggtgaaacagcggaaacaaatagagagaaggttggtaaattgaatcaaaagattttgctgttggagagtgagaataaaaaaatacgtgaaaatgtatgtgtaaatggtgtttatctcttggatcaattgaagaaggaaaagctgattgtgaagaatatgaccaaacaagagaaagaacagctccttgaatacatggatttgatatatggtaatttgatttctcggttaaagaaagattttaaattaacgagtggtaacctgatattgatagctttgcttaaagttggtttcactaccactgagttgatgtttacttttgactgcgagatgaattctatttttacgaaaaaacggagattgagggagagcttaaatttggatactactgataaattggaagaatttataactctttattagaagaacttcttgcttttcgtccattaacttagtagctttttttttagtattttcttgatatatagtttgttattctcttttgtgttgtccacttgtactttccctaagaagtgattaaatggctatctttgttacattcaaaactaaagatactatgaaatcattttttattttgttaagtttatactgcttctttgtggtaaatgtagtgaatggaaagtcagtaacttttccttcaagagtagaaatcatcatggatgaggattttgatttaccggatggtccggggaatggtcaccgttctattcctccagtgactccttttttagcatttttgaatgatgaccactccattgacttggagttctatcaatctataggtgagattgaaattgtaatttctcagaatggggatgttgtttactcttctactgagaatattgactctccaatattgagaaaagtacaattacagaaaggcttagttggtgattttttacttgagataaaaggtttggatggagcttatgcattcggtagatttactattcattaataatggctatatagcactatgaaacaaatctcattttgcatcacttgtatgaatcggcttaaacatttacaagaaactttggagaagaatattcttgataatttcttagtagatgaggtcgagtttgttgtgctggattataattcgcaagatggattagaagaatggattgctcaatctatgatgaaatatattgagatgggtattcttgtctattataggactactgaaccagcttattatcgacgcagccatagcaggaatatggttttcagattggcagaaggagaagtagtatgcaatttggatgcagataattacttaggtagagggtttgcagagtttatgttaaaagaatttaacaataaagagcgtctattttatacgagtaatctttgttatcgtgatgttttcggaagggtctgcttggaaagaaaggagttcgttgaggcgagaggatacaatgaagtgtttgtaggatatggtttggaagatgttgaatttttcaatcgtttgttgtgtagagggcttgtgcaggaaatttttaatcagaaggaattttataatgttttgatgcatgcagatgaagagcggatagcacaagagtttttgttgaagaagttgcagagtgtctatctggattatataaatccctactctacgagagtattgatgttgtataaaggacaacgttttggcataggagtgatacagaacaatattgcaatgaattataatcatccggatgaatcagacatgctaaaacaatgtataggggataaatatcgacttgtgataaaaggagaatggaaagaaggaatatgggatgagatggagaacggaattcgactgaattttaaagatgaggaaatgatacttagaaacaaatctaattgtttgtatgattttaatcatcaatattataaagttaaagatgcgaatctgatagtggtaattgtcatgggtgtaacagaggctataaactatctgaagatgaaaaaaatggataatgattgtaaaacggtaaatccgaatgggttcggacaagggattgtatatcggaattttgattatactaataaaatactcttggcataatatgaaacagaattatacgttgatgggaggaaaagcgtggtgttgtttttctgttttttattctcgaaaagcgtggggaagcctcttgactgaggttgtctcattctatcgtgagttccaaagtttgtttcattattttgtggcttatttctctgaacaacaaggagaacatatcaaagtcactttttcgtttgatattgagaatatggttgaaatacaggaaagggtcgatactcattttttacttttcttgaatcaaaatccgtcagtccatcctaaacagttccctttcggagaagatttgtggtgcttttatcctaacaattctttggtctggaatcagtataagatacaatatccggatttagatttattgctggataaacaatttacactttgcctttccggatttttgagtgatacttatgtgggaggcaaaaagcaaatggagggagagaactttaatttgctggagcaaatacaacaaaaagtgtttacagaacaaaatgggattaggcttgccaaatggggatgtttgatagaatgtttagctcaaaagtctttgatagagatggatgtggatgaacaacttacagatgtggatgaattcttgatagctttgtggcaagagatgaaagtgccttatatgggtacatttcagttcttattgtgggtaggagattattttctatttcgtttctatgacgagaattctttgtttcgctctcggacttcttggatgttggagcaaatagtattaggtgttgaacggcttttctgtcagtttgagtatagagtgaggtctgttgaaccattgtttttatttccagttgatgtttggcgagatttaggtgaatggttactgtgtgtggagaaagtttgtatatgtgagtcggtaaaaaatgtattagctaagttatatgctttacctgaaatggagtttttgttacattgtaatttcccaaagaatactttgcgttggaaatatcgtgaaataatatttgtggataaataatagagatagttttatgctatacataaattgaatgtttaattaaaattttgatgacaatgaaaaagttaggtaagattaaattggatcagcttaataaagctgaactcagtgaaaaggagttgaatcgccttttgggaggagaaaactgttgtttgtgtgcttgcgctggaccgtctggaccggttgacaactttaatgcaaatgttgcaggtagtctgtactctccatcgtggactggcggtactcatggatcacatagcatgtaggaatagtagtaaataatacaagtttgatgttttttattctttccttgtttataggagaataaaaattgtattttgcaactgtttgaattgtgaagtaagtaatttgtaccgttattttggaagtagtggaagtgcatgatatgtgtgttttctactactttcagaatgaggtatattgatgattgtatttatgaaaaattgttttttactgatagctattgcttcattcttattaggatgtagtggcaataaaaaggagaatactttgcaagatgaagagggtactccagttattaatctatcatcagacaatgtgtctaaggttgctttactaccattgagcgaagctgctgcgaaagtggagattgtttcgttggaggtgacggacgaatctctaataggagaaattactaaaatgaaggtgactgattctgacatctgggtgaaacattataaagacaatcatgtcctccgattttcacgttccggaaagttcttgaataaggtaggcaaagttggacaaggaccggaagaatatatcagaatggctgatttcttcgtggacgagaacaccaaagaagtatatatccagacgacaatagttggagttaaagtctatgattatgaaggcaattataagcggacagctgcaaaaacatctccggatgatgtatttatgacaatgtatttccaatttgcattgtatgataacaagttctttatagctcaaaatctggcatttatcaataaaccgacaccaaaagattcggtatggtcttttgcatgggttgatagtacttaccagaaaaaaaagatattcaaaaatccggcacatatcgggcgtgaagaggaaattatgaagaacggaattaatttccagcagtttgttaactattggttagaaccttttaccagtatagatacctatggcaatcagttgaccttgaaatatccggataccgatacgatttatcgttatgacagccctgcgaatgagttggtacctcaatatatcatttcaacccatgaagaaaaaggtgattatggggcgactcatgtttggtttagggaaagaagcgctttcgattatttttccatatattcttattatccgagtaaggataatatctatctgctgtgcagtaagggggaaaccatttatacttattgttatggcaaacagactggaaaagtgaaagtaaaagagcgaaaatccgagattacggaacgaatgctgggtaatcacacccttcgtaggctggaaggtgctaagtactttatcttggataatgatttgtgtggagggtcgttccatgtagattatcgttcacaaggaaagtattggatagatgtacttattccgaacagtgaagacaactggatagatatagacgagatgagaacttctgacgtaaaggatgaatctctaaaagcaaaattcatccatactttggagaatgtagaggaagagagtaatccgatattggtaattgctacattaaaatagtaaatgatggataagtcttttttgataactactgggaatcagcatcaatatgtatattcggatgctttgtgctattttctttatgtgccggaagaaatggcaactgtaatggaacatatggatgcatcacttgttgatagaacaaattattacgaacgtaaactgaaatttctgaaagaacattgtttttttgaaaagagagaggtaacatttcaaacagattatagtgaagaattggtaaaacgaaaccttgcagggttgcggcaattattgattgaagtaactgataggtgtaatttggaatgtaagtattgtggttatggtgaattttattctaattatgaccggcgagaaacaggtgaccagtcttttgaaaacgtaaaactattggtagattatttgactaaactatggtgttctgattataatgtttctcataaaaatgagattacaattggattttatggcggagaacctctgctgaatatgaaactggtgaaggaaacaattgcctatattgagagtttgaatttgccttctttgatttttaattacaatacaaccacgaatgctatgctactggaccggtatatggactatttggtggaaaagaattttagtattctgattagtttggacgggaatgaggtgcaatctgcttatcgggtagataagcatggaaattcgtctttctcacgtgtagtcagaaacgtaaagaaactgcaagaaacctatccggattattttgaaaagaaagtaaatttcaactctgtattgcataacttgaattctgttgcagaatgttattattccatcaaagaactgtttgggaagaatcctcgtatggcgcagctaaatactactgggcttattccggaacgtgttgaagagttttctaaaatgtttaatgatagagtgaggagctttgatgaagcagtgcaacacgaggatttgaagtatactttcattaaggatggcagccgttccgtgagctatcattcgatgttgatgcgatatggtggtaatcgttatgctacttatttggatttgtttgatacggggtgggaagaccgatacattcccacaggcacttgtcgcccttttgaacgcaaattatttttgacagttcgtggaaaaattcttccatgcgaaaagattggacaagaacatgctattggatatctgaaggatggaaaactgaatttggactgtgcagctgtagctaaatattatagttcgatgtacgaaaaggtagtaaaaagctgtcgacactgttatttaaaaaggagctgcggtcagtgcttgtttttgttgaaggaaaagaatgggcaattgatatgtcccggcatacaaacggatgctaagttgaaagaggagtttgggatttttttaacgtatgctgagaattatccgaatcattatgaggagttgttatcttctattgtagtcgattaattgaaaaaggagtaaatgcaatgaattatttattttatttggagccttatgcgtttttgttgcgtagtaatgacaaaacagtagtttataatactctgaatgcaacttatttgatttgtcctgattatccgattgtacagttgattattgaacagtggcaaaatccgacgaatgggtatagtgttttgttggataaggaaatgatggaaaacgaagttgtaagacattttgttgaggctgtaagagaattgttttcgggtgattgtatagaatatgacgggaaatttcctaagccttatatctttcagccaactttgttcttgaattcagatatacgtgtcaaagatgaggaaaaaaaagcctctttgggaaatcgtgttatggaaaaccttaatgaagtaaatctgtatttaccggcaacgtgtgagttggagtgtccggcttgtacttcttacttccatcaaataaatcactgtactgttcactccggtgatggactgaaaacagacgattatcgtcgattaatacgccaattcttgatgaatggcattaaacggattaatatatttgcaggaggaaatccgaataaaaatagctatgttaggcaattgcttcctgacatggaaaaatcaaaggtagatgtgcatttgtatttggataatacattcttgtgtagtgaatatgaagaattggtgcaacagaccaaatgtgttttagaagttttagtccatgctgaaggttttggtaatcagctgactgaagatatgcagaagttcccgtacgatagagtgaagtggaatttgatagtatccaatgaatctgatatggaacgtatagaaaaaatggagatacctgcagaaacggtagttcaaataaaacctttttatacagcggaaaataaagatttctttagagagtatgtctacttggatatgcaagatatattggctgcccctattgatagaaaaacgatatttaggcatcggactttgaatgataattttttcggtaagttaacaatttatccttcgggagaagtctatgccaatgtgaattgcagtgtattaggaaatatacaagattcatctttaaaggaacttctctataaagaaataacagaaggaaatgcttggcttagaattagaggcaatgaaaaaccttgtaaccaatgtgttaatagggatttatgtccctctatctctaattatgagctggtgataggaaaaaacaatttatgtaatataccaattgaataagtggacgtattcccatattatcgtcagcttgatgccatggattgtggtcctacttgcctacgtatgatagctaagttttatggtaagagctattctttgcagactttgcgtgcccgttcttttatttctcgcaatggtgtttccatgttaggcatcagcgatgccgctgagtctattggtttcagaacgtccggagttcgtgtctcttttgaacaattggcggaagatgttcctctgccttgcattttgcattggaatcagagtcattttgtggtttgctatgatgttaagaaaaagaaagggcaatactcgtttagaatagcagaccctgcaactcagttggttacgtataatgaactggaattgaagcgatgctggttagctaccaaatcggacggagaagagaaggggactgcacttgcactggaacccactcctgacttttataatggtgagggagaaccggaactgaaagaaagagggttgcgttttttcttccgttatctgactccctataggaaagagttgtttcagctgatattgggcatgttggtggtgagcttacttcagcttatcctaccttttcttacgcaagccttggtggatgtgggtatcagtgacggaaatttgagctttattaccttagtgctggttgcgcagattataatctcggtatcacaactatcggtagagtttatccgtagctggatattgttgcatgtgaatacgcgtatatccatctcccttatttcggactttttggcaaagttgatgaagttgccgcttcatttttttgatacgaagatggtgggagacattatacagcgcattggtgaccatgaccgtataaagaattttctgacaggttcttctattagtacgctcttttcctttgtcagttttttcatctttgctattgtacttgcttactacaatttggtggtattgggaatctttcttttaggtaacagcttgtatattgcctggatacttgcttttatgaaatatcgccgtgaattggatatccgtcggtttgcacaagcagccggagagcagagtaaccttgtgcagatggtgaccgctatgcaggaaataaagttgaataactgcgagacacagaagcgctggcagtgggagcgtattcaggtgaaactgtttaaaatcagcgtaaaagggttggctttggggcaagtacaacaagtaggttctgtatttttcaatcagaccacgaatattataatctcgtttattgcggcaaaggcggtggtggaaggggagatgacactgggtatgatgatgtctctgacttatatcatcggtcagctcagtgcgccggtctcttcttttataggatttgcgcagcagtttcaggacgccaagataagtctggaacggctgaatgaggtacatgggaaaccggatgaggagcaggatattgcttccaaattgtccgttttgcctgagagacgggatataaagatggaaaatgtgtgcttcagttacgatggagcggatagagactatgtgctggataatgtctctttagtgattcccgaacataaagtgacagctattgtaggtgcgagcgggagtggaaagactactctggtgaaactgatgcttggtttctattcgcccaataagggggctgtgaaggtgggtgatgcttcgttagagaacataaatccccacttgtggcgtgccaagacgggagccgtgatgcaggacggctttatcttttcggaaaccattgcgcagaatattgctgtgggagaggagcagattgatgtggagcggctgcgccatgccgtggcggtagccaatatccgtgatttcatagactcgcttccattggggtataacaccaaaatcggtatggagggaaacggtatcagtcaggggcagaaacaacgtttgctgatagcgcgtgccgtgtataaaaatccggaatttcttttcttcgacgaagccaccaatgccttggatgcgaataatgaaaaggagattatggaacatctgcatgaattctataaagggaaaaccgtagtggtagtggcgcataggctcagtacggtgaaggatgccgacaagattgtggtgctggataggggatgcattgcggaagaaggtacccatcgggaactgacggagcggaaaggaatgtattatcggctggttaagaatcagctggaattgggtagctaatgaatggaggaagagaagatatataaggatatagaacttcgcagtgaagaagtgcaggaggtgatgaaccacatttctccttgggtggtgaggtgtgggattactgtcttggcagtgattctgttgatggtactggttggttgttggatattcaggtatccggacaccttggcggcagaggtgactctggccacggaggaacctcccgcctttgtgctgtcacatgctactgggaaactcgatacgctttatgtgaagaacgggagttcggtggaggcagatacggatttgggtgtgattggtaatgcggcatgttctgaagatgtacgtctccttaagaaatggatgaaggcatgggaaacgcaggattatgattggcagaaaggagtggagctttttatcggcaggcgctggcagttgggggaactgcaatcggcttttgcagctttcattacttcacttacagaatatgcacgttttatggagttggactattacgctcggaaacttcgttttcaggaaaaacaactgggtggacaacgctcctatcttcggttggcagagcgggaatatgagttgattgataaggatataaagcttgccgagagtatgtatatccgtgattctattttatatgtgcgcaaggcgatgattgctgcggaatttgaggagtctggaagcagatatttgcaaagtttgcgttctaaagaagaggtacgtatgagtttgcttcaggcagaaatgcagttggtgcaacatgaggagaatatgttggatatacgtaagcaagcatacgatgaggaacagagtcgtcggactgatttaaagaatgccatagggcagttagccgcgcaattgagtgcatgggagcactcttatttattgaaaagtccggtcagggggaaggttacttttatgacggtttggagtcgtaaccagaatgtgaaagccggtgagacggttttcacgattcagccatccgacagttcaagggtgttaggtaaggctctacttcctttgcagggttcgggtaaggtacatgtgggacagcgggtgcatatacgtctgaataattatcccgaccaggagtttggctatgtaaaagggcaggttgcaagtatctctcctgctccaacggaagagggaatgtatatagtagaaataactttgcctgacggcatgcagaccaactacggcaaacagctacctgtttcgcgtgagttgaaaggtacggcagacattatccttgctgacaagaatgtactggaaaggttgttggctccgttgaggaaagtggtggaatatgaaaaatgaaaaatagttctatgtaaatttcgtaattcatttgtttttagtatgtttgtgctattcgtatatatagtatgaaatactaaggaagagaatgttcttaatgaaagtatgaaaagaagagttaaagcattgactgttgttttggcaatatgtcttataactgtttttattcgatgtcagtcggatgaaactcctattcagcaacttatagttgttgtgaatggggattctattgagatggtttttgtgaaaggaggtacatttatgatgggatgtacagatgagcagggatgtgactgtgaggataacgagaaaccagcacgtaaggagtcggtatctgatttttacataggaaaatatgaagttactcaaaggctgtggagggcggttatggatactgattccattttgccgtttaatgggggatgcgaagattgcccgatggaaaatgtaagctggaaaaatgcgcaggagtttatcggtagattaaatgctatgaccggtaaaacatttcgtcttccgactgaggccgaatgggaatacgcagcgcgtggtggacacaaaagtaagcactataaatacagtggcagcaatcaggtaagtgaggtggcttggcatgttgggaattcctctggcggacaatatggagaagctggaactacccgtccggtaggtctgaaaaaaagcaatgaattgggattgtatgatatgagtggcaatgtttgggagtggtgtggtgatttgtacactaaagaatacaagcaaggtggtaagtctatccatccgggatggccttttgagggtacttatctttttttccgccgaatattgcgaggtggaagttggggaggaacagcaaaggggtgtcgggtgtcgtacattgattacgacattgagaattatagtgacgagtatggaggttttcgccttgtgatggagccggaatcgattaaataatgtaattaatgatgataagtgatattttactactttcagagtaatgaatagaaatggtatgagatatatgtggaaattctttttattattgatgttggttgtaacttcgtgttccgaaaagcagattgatggcaatgtaattaatgttgcggaagcaatgagtagattgtcagaaggacaatctgtacaaaatttgttttccagcataagttatattcctttggagactaatgagcaggctattataggaaaatatccggagtgcataattatggatagtgcgatattggtatcttctgtccatcagaatctgaaactttttgaccgtactaacgggaagtatattcgggatattggacacgtaggtactgatccggaaggatatgcaaaggattcatgggggaaagtgagcttttgggctgatacggttcggagaaccgtttatctattgggatggaataatgatttcctactatatggatttgatgggaaatataaggatagaattcgattgcaagatacagtcaattgtattctgtcccaaaattactatttgatggatgcggacagaatttggggacataataaaatgaaactctctccggagacgccatcagtcttttatatggatagaaatacgatgtcattgaccggtattgctacatggaattcagccctgcttcccatggatgaggttttgtcggtttcaaatttgttgggggcaatgttgcttatggaggtgacttggcaatggcagaatttgttggtgaccggaaatattatacggcaatcaatagcccttcgttatggaaatctaaggatgccatccgagtgaaacaagcttttaatgatactatctatactatttcagagcagggacttactccatatctggtttttgaactgggtgagtggcactggaatgagcagcagcaattggatgtagaaggatgtgataaaaaaatagccatagactatattctggagaatgcagagtacatctatttccattttcatacaagcttatatttagaagaaagtcagtcatattgtggattttaccataaggaaaagaaaactgttgtttgccaaaagggtgatagcttatttgataaaatgaataatcagcatatccaaatcaggggagtcacttcggatggacatttttttgctttgttacaaccggatgaactcagtgatgataatcaacggagaatgggagtagaagaggaaggtaaccctattatggtcatgctttattaagtacttattccgtcgtcttcccccttgcatccaaataccctcttttaaacatatccacgaacagaaagaatagtgacaagagcagtggcccgaagatgacacccatgaatccgaaaagggacaagccgattacaactccgaagacagtgataagcggatgaatgtctgccattttcttctggatgatgaagcgtatcaggttgtcgagctgtgaaatgactgcaccgccatagatggccaggccgatagcttgaacccagttgcctatcaatgccatgtagacagctatcggaaaccataccagcgctgttcctaccattgggatgatgctggcgaagcaggtcaggaaaccggcgaacaagatgttgggagcaccgaaaatccagtagcctatcatggctactcctccttgtatgacggcgagtaaggggatgccgatggcattggagcggacaatcatgttgatttcgtggatgacgttttgtgtattgtcatcgttgaacggcagtaggtcgttgacgtactgttccatctttttgccccctatcagcatgaagtagagtacaaagaccagtacgaagatgttgacggcaaaactgctgatacctcccatgatggcttgcccgatgcggggaagaattgaaatgacgtatgccaccgtgtctttccccaagatatagtagccggttttggctttaatgatgttggccgcttcttcgaaaggagctataatggcttgcgggtccagattgatgttttgaagattgaccacagccagccataccaccagcccaagtggaaccagaaagcagagaattgcctctgccgtaatgagggtggcagctatgctgcgcttcattttccgcttgtcggaaaggtacatcatctgctttctcaccaggatatagatagtcaaggctcccagcagaccgcccatgaatggggctatttgtctgaaaagaatgattcccagcccgataatgatggctatcaatgaatatttccagtattgttcttttgtgctcataaagttcctgtatttcttagtaaagaaacataaaagaagttgaaaaggtttggaaattgtggccggaattcaatatttatccttcgtccagccagcctaacccctggcgtatgatttccggctccccattggtgcaatccactacggtagagccttccgtaccgccgataccgccgtctattaccaaatcgacaatatcaccgaatttctcgtcaatcagttccgggtctgtgcagtattcaatgtcctcattgtcctcatgcggcaatgtagttgtcatgatgggagcatccagcaggcgggctatttcctgaatgatggaattgtccggcatacggatgccgacctccttacggttacggaatatcttgggcaggcgggtggtgccgttcagaatgaaggtgaaagctccgggcagattacgcttcatcaacttgaaggtgctgttgtccactttggcgtattcgctgaccttgctcaagtcgtagcagatgatggaaagattgttcttcttggggtcgatatttttaagacggcagatacgttcgatggctcgttccttcagtccgtggcagccgatggcatacatggtgtcggtagggtagataaggatacctccgtcattcagtaggtcgaccacctgctgcaggtcggcgggattgttatttttttcataaagtttcagaagcatggcagaaatggatttgagttttatattacatgcaaaaatagataataatcggcttataaacaagcaattcacctttttagcatctctttctccagtttctttatcttcttccaggcctctttgaatttgggacagagggtgacggctttctcatagtttttcatggccgcctccttcatgtcatgcttcaggcattcgtcacccataaggatgtattcgcgggcatacttcacgagggctttctctttctccaatgctgcttgcttcagtgcacggttttcctctttcagacggttgatgatgttcagcttccggcggatgaggcgctgcacgttgggcttctcgatgtcgtagcgggaatggatggctttgaaaaactcatccaggaaagtgccgaagtcccctttgtcgaaggctttggcggcggcaacgtattgaacgtctgcctgtgcttgcttcaaggcacggtcgatggcggtgcggttgttgaagcgttcggagaagctgacaatctccggacgcacgaatacatcggcacggctgatgggctttttcagctggatgccttccagcgaggtgcagcggctgagggctacgtatgcctgcccaccggcaaacacgccgccggtaaagtcgatgactacccggctgaaggtcagcccttggctcttgtggacggtgatggcccatgccaggcgcacgggatattgtgtaaaggttcccagttcttcctcttcaatctgtttcttttcttcgttgtatttgtagcggatgtttcgccacgactctcgtttgacgtcacattccttgccgtcgtcggtgatgacgtagagggtctcttcaatagggtcgaagccgctgatgacgccgatggtgccgttcacccagcggcggtcgaagtcattcttgatgaagatgatttgtgcgcccggtttcagtaccagttcctgcgaggtggggaggctgctttcgggaaagtctcccatgatttcgccgtagaaggtgaccgggtcaccgggaagttccgccagttttttgtcgttgatgtagtccacattgtcacggcgggtggcgagggtgatgtacatgtcggcttccgattgctctatttgggtgccatagcgggtgttgagcagctgaagttcggcagagccgacggtattgttgcggatgtggtccagcacatggatgaacttgctgtctgtttgccggtatactttctgcagttcgatggagacaaggtctatctggccgaataccctggcagagaagaaataaggggtagggtagaatcggttcagtatctcccgttcatctcctttgacgacgggttccaactggaacacatcgcccaccaataatatctgtttgccgccgaagggttcgcgcaggttgcgggaatagacgcgcaggatgcggtctacggcgtcgatgatgtcggcgcgtaccatggaaatctcgtcgatgatgaccagttccagttcttccagtagtttgcggtggggtttggtgtatttgaaaaattcgtggatgcgtccccgttgcagactgaagttcgggtcatcgggcagcagggggtagaagggcagtttgaagaagctgtgcagggtactgcctccggcattgatggcggctattccggtaggggcaagcactacatgctttttcttcgtattcgcgcagatatatttcaggaaggtcgatttgcccgtacctgctttgcccgtcaggaatacggactgacgggtatactgaatgaggttcaaggcatcttgaaactctttgttttgtgtatcgggaacgaagctcaaaagatttcagatttatgatggattcccgactatgccgaaatatttcagggcgttggcgatgccgtcttcatcaacagaagtggttgtgtagttactggcagcttttacgtcgttattggcattgcccatggctacaccgataccggcatggcgcaacatgctgatgtcatttcctccgtcgccgaaggccatggtctcttccagcttgatgccgaagtggcggataatctggtcgataccgttttgcttggtgtttcctttggctgtcacgtctacgaaggcaggatgccagcggcccatctcgcagtgggggacggagggcaggatgattgcttcttcctcggcgttgataaagggagtcagctggaagaaggctttgtcggcatggctgtcggtatagggctttgcttcgatggggtccactttcaattggtgatggaagatttcctccactacttcgccgggctggttcacgcagatgtcgtgctctcccaccaggatgcatgggatgttgcgttcgtggcagaaagctgtcaaggcatccacttccgctgtcggtatggggcttttgtagataacggtgtcttctacaaagcaataggcgccgttcatcgtgatgtagccgtctatcagattccgttcctgcaaggcggacaagttgttgatgatgacgcgcggacgtccggtagaaatgaagatatgtatgcctttggccttggcggcagtcaacgcttcaatagtggaaacgggaatttcgtgggtcttgaagctgaccaaggttccgtcgatgtcaaaaaacagagcttttatcataaggggttcttttatcttgtgcgcgaaattacttaaaaaagcgaagatatttcgtacttttgcgcacaaataaatgataaataacaaatgaagaaacattctttgaaagattggatgatagcggtgcgtccgtggtcattccccgcctcttcgatgccggtggtggtgacgttggcatatctgtattggatgcagcaggacataaactgggtgaacggtatctgggcattgttgaacatcattgtgtttcacgctgccgggaatacctggagtgattattttgactataagcataaggtcgatgcaagggatacctttggcgccaagacactgactgatgggatgtttaccccgcgtgagatataccgcttgtcgatggcattgctggcagttgcccttgttgcgggtatcggcttgttgtggcgtaccggcttgccgctgttgtatataggtataggcggtgcagcttgctcgttgctttatccaccgctcaagtatcgtgcgttgggcgatgtcgtcatctttttggcgtatgccttgctgccgacgttgggtacctgctatgtggctacgggagtagttgactggaatgtcttgtggatagctctgccggtgggactgattacggtggccattctgcatgccaataatacacgggatatgcgtaccgatgcccgtgccgagattcagacactggccatgaagctgggaggaaaggcgtcgatgtacgtttattgtgccgaagtccttttcccttttggctggatagccggcttgatagctgcgggaactcttcctctatggaccctgctggtgatgccggcactggttcctgccataggcaatgtacgggtggtgtcccgttttcccggaaagggagaaagtgccatagccggtctggatgagatgacggcaaaactccagttgttgttcagtctgctgttcacgttgtcgttcgttgtagccggtttgctgtcatgaagaagctgatttttaccattctgatggctgccgtgctgtggacggtcatgttttcgccttggacggctcctttcgtgaatttctggtggatgatgaccggttctgcgctcacgctgtccgtgtttgccaccttgttcaatcccggctggtggcgggaggtgaagtggagcttgccgaatgtcttgctgggacttggcattgctgttgctttgtggggcgttttctggttgggagacaaggtgtcatcttggatgttcgattttgcccgtccgcaggtggactccatttatgggatgaaagagggagagtctccttggctgctggcagcattgctgctgttgctgatagggccggcggaagagattttctggcgcggctatgtgcaacgcacgctttccaaacgctggaatccgaatgcgggttttgtggtggctactttgatttatgcactggtgcatgccggttcctgcaacttcatgctggtcatggcggctctggtggtgggggcggcatggggcgcgctttaccgtttctttccgaaccgctttgccgctattatcttgtctcatgcagtgtgggatgtggtggtatttatatttttcccgatatgattattgtttacaaaaataaggtggcggtaatgggtcgtataaaaacaagacaaattgatgcgttgaattataaaaaagcaagcatatgacttacaattttgatgaagtaatagagcgccgtggtaccgactccgtgaaatgggacggtgtgaagagtgtatggggacgcgatgacctcctccccatgtgggtggcggatatggatttccgcacgcccccgtttgtgatggaagccttgcggaagcgtcttgaacatgaagtgctgggctatacgtctgcgtgtgaggaatggtatacttccatttgtagctggctcagtcgtcgccacggttgggacgtcactcgcgagatgctgacttttgtacccggcattgtccgcggtcaagccttcgcattgcaatgcttcaccaatcccggcgaccgggtaatggtgatgactcccgtttatcatcccttcttcctggtgacgcaacgcatgaagcgcgaagtggtttactctccgctcgacctgaaagatggacagtatcagattgactttgagcgtttccgtaaggatatacaaggatgcaaagtattgattctctgcaatccccataacccgggcgggcgtgtatggacggtggacgaattacgccggattgctgatatttgtacggaaagccatacgtttgtcatctccgatgaaattcatgccgacttgactctgccaccttacaaacaccatccttttgctactgtttcgggggctgccgcgcagaattccctcaccttcatggcacccagcaaaacattcaatatgccgggattgggaagttcgtacgccattatcctcaatgaggacatccgccaccgttttcaggagttcatggaagcgggcgagttcagcgaagggcacatgttggcctatatcggtgcggctgctgcctatatgcatggtgaggaatggttggaacagctgctggactatataaagggcaatatcgatttcacggagaactacctgcgcgagcatattccgggcatcggcatgatacgtccgcaggcttcttacctgatttatctggactgccggggattggggctgactcaggaggaactggtgagactatttgtggacaaggcacacctggcactgaatgacggcaccatgttcggtgaaccgggtaagggatttatgcggctgaatatcggctgcccgcgttcggtgttggagcaggcgctgaagcaactggaaactgcggttgcagacaaatgatagaaaaaactatatctcctatattatgaatagattacctttccttggactattgtttgcgttgctgtgccttgttgcctgccggcagatgaatgaggcacatctgttacatctggcagaaaaacaggtgaatatgaatgtggacagcgtgtatgccttgctggtacagatagagaggccatcgcaactttcggatgaggagaggctgttgtatggatggctgaatgcttatgtgcactataagcggcacaactcgatggcggaagattccttgatattgcctgcttccgattattacgtcttccgcaacgacacggcgaagaatctgttttcctatcagttgaaagcctggtactggtattggctgaaagagcacgaacggtgtatagctgccattgacagcggcgtagctttggccaaggcgctgcaggacacgggaagaatggctgatatgctgattgataaggcatactggtatgtgtatgtctggaaagattatgagaaagcgatagaaactttccgtaccgccatagctttggacgcaagagccggaagcttcttctctatgggaattgccatggggctgaacaagaatgattctgcatcctattacatggagcgcagcatagaactggcagtggaggcagaagataccagtaagatagtgcattatttgcgtaactatgcccagatgcaggcttactcttttgatgaaccttccggtgcaatagctactattcgtcgtatggagcagtatgtcatcgacccggtgcagttgcgtatgggagatctggtgaaagtggaagtgttcttgaaagaagggctgcttgattcggcggaatactatttgaataaggagaggaaacgtggcgagggccggaaccggtttttgacggaagagaatatggtggcggtatatagggcattgatagattatacacgtcaccgtacgtttgatgtgctggacgtggcgcgctataatgattctgtagccaatgctcttactgcgttgcagagtactgtccggcgtaaggacgagtcgaaggagacgctttcgcaagccaacttgattctgacggtggaacggaagcaggcacaactgaatttgttgctggcactgttggtactggtgcttgcaggtggtggtgtgtccctttatatccgtaaccggcgcaaccggctgattgaagcggaagaacgggcggaaacactgacccggttgctggaagatgcgaccaggaaccagtcgaaaggggaagacgggcagttttttcggaaaatactgttgcagcaattaggcatgatacggctggtggctaaacaacctacctcacagaatcaggagctgcttcgccgcatttcgggtattaccagccatgaactgccggtagagagtttgctggtatgggaggacttgtatcctatcatagaccggatttatgataacttctacacaaagatggacagctgttttggcgatgtgctcattgacaaagaaaagcagctttgctgcctgctctgtgcggacttctcgacgaaggagattagtgtggtgacacaacagagcattcctaccatttaccagcgaaagacgaatatccgcaagaaactggggatgggggagaaggaaggcatcgtagagtttataggcagcatatagaccggaaaaggcataatatagacttttgtaaaattaaagtgttgatatgtagtgatttgtagttttgggatatagactttttattcctcgatatagaccgtttgaggcatgttttacccctacctttgtatcagcgaaatacaaggtgtgaaatattgaaatcaaacgcatgatgaaagaaaaactactgaacaacgttagaaaaagagtgatggtatgggtggccttggcaagtatggcaactctgcttcctgctcagacttaccggctttccggttgtgtgcaggacgagaaccgccaaccggtagaggtggcgaatgtgctgctgaagcaggcaaaagacagtacctatattaccggtatgctgaccgacacacaaggttgtttttcctttgaccagccactgggagaatacttgttgcatattacccttatcggcagcgaagacctctacgttcccgttgtgctgcaaggaaacaaaaacgttggcgaattgacattgaaatcttcttccgccttgctggacgaagtgaccgttacggccgcgcgtcccgttatcaagcgtctggtggatagggtagtgttcgatgcacataataccatagcctctgccggaggcagtgcactcgaccttctgcgtgaagtgcccggtctgcaggttggacaaaacagtattggtattataggtaaagggggtatcaaggtttatatcaacgaccgtgagacgaagctgtcgggagatgaactgatagattacctccgttcctatgacgcctcccagatactgaaggtggaggtgattaccacgcctccgtccaaatatgatgccgccggaaatgcaggcatcatcaatattcgcttgaagtcacgtcccaaagattacgtgggtggtacggcttccgcttcctacagcgctggtgaaaaggacaattacggatatggcggggtaagcctgaacctcagcaaggggcgcgtgtcatccttcctcaacgggggtactacgcagggcaactatgagacgcgtgagaagaattaccgctattttccgcagaacacctggaacagccgtgccgactacaccaattacatgaatagcttctaccttcagggaggtgtggacgtatcgttggaacgggactggactgtaggtatgcaggccatctataatcacagtgctcccaaaccgggcaacgccctttcatggacggaagtttacgatgcctctaccgccgtattggattctttgctgtactccaacagtgacaaggataccagttccgaccgcctcaatctgaattttcataccgataaggtctgggatgacaaaggcaagaaaatgacttgggatgtggattacctgcgtgacaaccgggacgaaaatatgggctttctctcgaaaaccctcctgcctgacggtacggagattccgggcacaaacttcgattacaactatctgcaacatcgcaaggtagatgtagtctcctccgctcttgatttcatccttccttttgaaaagtacaagataacggcaggtgccaaggtctcctttaccaacactcgcaacggtatcaattacgatacatcggaccctacgctggtgcaggatgattatttccgttacaaggagcaaatctatgccttatatgctgattatagccgtgaattttccgaacgtttttccatgcagttgggcttgcgtatggagcacacccgcactaccggtatttccgaagcgaaggatacggaggacaagcacgactatacgcgcttgttccctactgtctatctgctttattcgcctacagacgggcatgcgctgaacttcagtttctccaaccgcatctcccgtccgtcgcagaatatggtcaatccttttccgttctatcagaacaaatatacatatgcctgcggacgtgaggacttgaaacccagctacacttacaatgcagaactgggatatacgttgaagaacaacttcaatgtttccgcttattattcttattcggacgatgtattcttccaggttgtggacttggatgccgaaacgaatgtgacttctttcctttgggagaatttcatgaagacgcatgctttcgggcttaacaattcgtacactttccgtaccaaatggctgcaagcttacgcccagcatggagtgagctatcgccggactacctccagcgctgtcaccacctctcccgaggagaaaggatgggcttatgacgccagtctgcgcaacactttcttcttcaatgaaaagaagactcttctggccacgttgtccggttcctattcttcccgtcagtatcagggcatctatctgatgagtcccacttacagcgtcagtgcaggtatgctttaccggttgttggacaataagctcaacctcagcctgaatgtcaacaatctgtttgtcagccattccaaattggaaaccatgtccaacgggctgaagataattgcagataaccagttctcctttaccagtttccgtatcggtgtatcctatactttcggtggagatatacgtagcaaggggcagcggaacagtaacgaggatattcagagaagattataataagaagtttattgcgtgttggcaattgggagaaaatacttatctttgtgatacaagcgattgtaacaacgattaatataaaaccatgatgaaacagaaacttctttacctattgccactcttcctattgtcgggatgcgggcaggctacttacaagaatgcatctctgccggcagaagagcgtgctggacttttgctgaaggaactgacgctcgaagagaaggtgtccttgatgatggacagctccaaaccggtggaacgtctgggtatcaagccctataactggtggaatgaagcgttgcatggagtggcgcgtgccgggctggccacagtgtttccccaaccgattggtatggcggcatctttctcgccggagactgtatacgaggtatttactgccgtatccgatgaggcccgtgccaagaatgcctactatgcatctcagggaagtcgtgaacgctatcaaggattgacgatgtggacgcctacggtgaacatctaccgcgacccccgttggggaaggggtatagagacttatggggaagacccttatctgaccagccgtatgggagtgatggttgtaaaggggttgcagggtacgaacgatggaaaatatgacaagctgcatgcttgtgccaagcactttgccgtacactcaggtccggaatggaaccgccatgagtttaatgcggaaaatatcaagccccgtgatttgtatgaaacttatcttcctcctttcgaagctttggtgaaagaaggaaaagtgaaggaggtgatgtgtgcctacaaccgttttgagggcgatccttgttgcggtagcgaccgcctgctgatgcagattttgcgcgatgagtggggatttgacggtattgtcctttcggactgtggagctattgccgatttttacagagattatggtcataagacgcatcttgatgcagagtccgcttcggcggctgcggtgttgagtgggactgacttggaatgcggttcgagttacgaggccctggtagaagcggtgaagcagggaaagattgatgaaaaagcagtggatgtagcagtcaagcgccttttgacggcccgctttgccttgggtgaaatggacgagccggagaaggtgtcctggaccggcattcctttttctgtggtggcttctgccggacacgattctctggcgctcgacatggcgcgcaagtcaatgacactgcttatgaacaaggataataccttgccgttgaagcgtggaggtctgactatagccgtgatgggtccgaatgccaatgattctgtgatgcaatggggaaattataacggtatgcctccgcacacagttaccattctggacggaattagaaaagctttggggagtgatgaccggcttatttatgaacaaggctgcggatgggtggagagagctcagatacagagcgtcttcaaccgttgcaagactgccgacgggaaacccggattcagtgcacgctactggaataacgtgactcgtgacggtgagccagtcactactgcccaagtgaccactcctttccatttctgtacatccggtgccacggtttttgctccgggtgtgaaccttaccgacttctcggctacctacaacagcgtattcactcccgaccagtcgggagaggtggtctttgacatctatgcttatggctcagggagattgcggataaatggggaggaagtgagaggattctccaatcagcacggtgggcagaagagtgcttatactttgcaggtacaagcaggaaaaatgtatgacgttgaattggattttgaatatttccgtagcgatgcactgctgaacttcgaccttggatttaagaatgaagtggatgtgaggaaatctgtggagcgtgtaaaggatgctgatatcgtggtctttgtgggaggagtctctccgaacctcgaaggcgaggagatgggtgttgagcttcccggattcagaggaggtgaccgtaccgatatcgagttgcctgctgtccaacgggaactgattgccgccttgcaccgtgccggcaaaaaggtggtgttggtgaactgttcgggttctcccatcggtctggagccggaaaccgggaggtgtggagccattctgcaggcatggtatcccggtcaggcaggcggtacggctgtagccgaagtattgttcggcgattacaatccggcaggacgcttgccagtgaccttctaccgcaatgtgtctcagctcccggattttgaggattataacatgaccggccggacttaccgttacatgacccaggaaccgctttttcccttcggtcatggattgagctatacctctttcagctatggtgctgtggtgcttggttcggataatataaagtccggtgagaaattgagattgagtgtccccgtaaccaataccggcaaatgtgacggtgaagaggttgtgcaggtctatttgaagaaaaacgatgatgtagaaggaccgagcaaggcattgcgtgctttcaagcgggtacatatcccggcaggaaagacggtcgatgtagagtttgatttgggtgataaagagttggtgtggtggaatccgcaaagcaataccatgtgcgtttccgaaggcagttatgaactgatggtgggcggtagctcgcaaactgctgatttgctgcgccggtcttttgtcattcagccttgatacatcactgacagagtcaaaaaaagttttccgcttgagggtgagttatgaccctcaagcggaatttttatatactgggaatacatgttcttaataatccttaatactatatgttaactcccttgtttctttgtacttctctaattttaattgatatatttgtgatatcattatgatatcaattaaatttatagaatatggaaacaaaagagtgtggtttcagtggtttcaagatgaatggctttctggccttgttccttcatttggtagtgcttacggcggtgataatctttggatttctcatttctgtgcctaccttgatcctttcggtgtgtttgtgtttggtatggttcattctgtttgccggctatatggagctggagccgaacgaggcgcgtgccatggtgttctttggcaaatataaagggacgttcaaggagaccggctttttctgggtaaacccttttcttaataagaagaagctttcgcttcgtgcacgcaatctggatgtggagccgataaaggtgaatgataagattggcaatcccatacttataggattggtattggtgtggaagttgaaagatacttataaagccatgtttgagattgactcgcagacgatggctgcatccactcccacagcaggcaatgccaaccaggtgagccttggtaatgcggtggccaaccgtatgaatgcgttcgagaactttgtgaagatacagagtgatgccgcccttcgtcaagttgccggtcagtatgcctatgatgataatgaggctgatacggaggaactgacgcttcgctccggtggcgaggaaatcaatgagcagttggaacagaagttgaacgagcgtctggccatggcgggtatggaagtggtggaagcccgcatcaactatctggcgtatgcacccgaaattgctgctgtgatgctgcgtcgccagcaagcatccgccatcattacggcacgcgagaagattgtggaaggggcagtctctatggtaaaaatggcgctccataaactttctgaag
